United States Patent 12,329,181 (MICROBIAL FEED SUPPLEMENT COMPOSITION AND METHOD) - sequence listing, part 5

SEQ ID NO: 6052 - protein, 668 aa, Lactobacillus casei
MKKLFERIRMPEFLEDMRMRYAAIAMVVLAVIGILIGALIRPWLALLMLLILISLVATIFYALETIAKNTNQYISDLSYRIKRGEQEALIKMPIGIMIYDEDLNIEWTNPFLQKYFGDTDVLGQPLEKVDAELAELIRSHEDTNETKMVTWGQHQFEIIVQKSIGVVYLMDVTRYAEIEERAEDEKIAIGQIFIDNYDEITQTMDDQVVTNLNSYVTNQLTDWANQFGMFLKRIDNDRFFLLAYAKSLRDVERDKFKILDAIREETSKQNYPLTLSVGIAYGDEDLAQLAVTSQSNLDLALGRGGDQVVVRAKGHEARFYGGKTNPMEKRTRVRARMVAQALQELFKQTDKVFVVGHKRPDMDAVGAAMGIRRIAQMNGKECYIVIDPDHLHSDVERLMGQVGQDPEVANAIVTPEAALSQATDQSLLILVDHSKPSISAAPELYKRLAARTVIIDHHRRGEEFPDNPMLVYIEPYASSTCELIAEMFEYQPTNVPSLDKLEATAMLAGITVDTKSFSLRTGTRTFDAASYLRSMGADGMLAQNLLKENIDSFIQRNHLIDTIEMIAPNMALCTGEEDKRYDPVIAAQAADTMLSLNGVDASFVITKRPSGDIGISARSTGDVNVQVIMEAMGGGGHLSNAATQIKGKTIAEVRTDLLAQIKKADEDA

SEQ ID NO: 6053 - protein, 151 aa, Lactobacillus casei
MKVIFTQDVRGKGNRGQVKEVPDGYAENFLIRKGLAKAATPQAMSALRGQQRLEEKKEAEKKAEAEALKAKIEDDKTVVQIQAKAGEDSRLFGSIPSKQIATALERQYQIKVDKRKIDLKQPIRSLGFTNVPVNLFPGIDARIRVHVLEQK

SEQ ID NO: 6054 - protein, 481 aa, Lactobacillus casei
LQYFNSEVLQSEMAEWKGTRMDNQLIEQQPPHSDEAERAVLGGIFLNADTLPDAQEYVTADDFYKKAHRLLFQAMTDLQDNGTAIDTVTVTDYLDNHNQLDDIGGAGYITDLVASTPIASNVVYYAKIVQQKSTLRKLINTAQNIASRSYTEQDDVEGLVEDAERQIMDVSENRNQAGFKQIKDVLNQAMAQIDQLYQNDQTITGLPTGFRDLDKITTGLHEDEMIILAARPAVGKTAFALNIAQNVGTKTDKSVAIFSLEMGAEQLVNRMLCSEGSIDANHLRTGQLNEEEWQNLIIAMGSLSKAKIYMDDTPGIRMAEIRAKCRRLAREQGDLGLIIIDYLQLIEGSGQENRQQEVSAVSRQLKKLAKELHVPVIALSQLSRGVEQRQDKRPVLSDIRESGSIEQDADIVAFLYRDDYYRDAEGDDDDDRGGSDDGDDNVGEVEVIIEKNRSGPRGTVKLLFVKSYNKFTNIAYNGPDQ

SEQ ID NO: 6055 - protein, 387 aa, Lactobacillus casei
MDAILMSLMTALNEHLLINVYQRDTDDFYTGYVQVLGHDAVVLGTYNDSGIADGCALIAFSAIDQVEFAGDDLDNMNFRIGLAQSEHFLTLQGKEKPFQFDATESLIWQLAKQAQASEQMVMVVVADDDAYLEGRVTAVAEDRFSMAIFNKFNYTDVRALQVDFSDILVMEFHGLDLKLETELVRHRDQLQHVPTKLFQNDGQLEGVFQNALAENRLISVVPKGPEDQFFVGRVKAVNDRVVVLSLKDMAGQFGGYILMTLPSIQNVAAASDYLQTISFYEQWDQTHHFSQQPVLNADREFDPNDNLVKAIISEAAGFERVVRIKVADSDEHFLGYPEHVDETDFDLKLVGQDSGETVRIRYGQIREIAFGHIFAYLQEAQLKNADR

SEQ ID NO: 6056 - protein, 681 aa, Lactobacillus casei
EIIBCCMPNENTMGQDKYQIMGDGIYAQVGGPQNVAKLIHCMTRVRMTIKDNTKVNVAGLKKVPGVLGVVEEETLQVIVGPGTVNKVAQAMVAKVGVGLGDPFPDSAVTGNDHLDNKSAVEAKAAEVHAAHKASLKQTWWRTALKHISAIFIPLIPAFVGAGLISGIAGILANMLAAGQLPKDWTQFITVLKVINGGLFTFLNIYVGINAATEFRATPGLGGIIGGLIYLPGVVEPVTINNIFTHQPLLAGQGGIIGVIFAVWLLALVENQLHRVIPDSIDIIFTPMLSLLSIGVLTIFFIMPLAGWVSNSLVGSINWILQVGGAFSGFVLGLAFLPMVMLGLHQILTPIHLEMIKNTGFTALLPILAMAGGGQVGAALALWIKCRKNKQLTRLIKGALPVGILGVGEPLIYGVSLPLGRPFITACIGGGIGGEVVGAFGHVGAITIGPSGAALIPLIANHQWMAYVFGLLASYAGGFVATYFFGVPKSAMVATAADGTVIDEADSQEEDPSPEQPTADQEAESTTVQTGAINFVAPATGQLKDLSEVADDVFSQKMVGDGFAVEPTSGTIVAPVDGTIVSVMPTKHAWTMTTSTGLEILVHMGLDTVELNGAPFSVEVNDQDTVKAGQPIATMDLAAVKAAGKGTTVMTIITNMDHVASLTAFTDQDVAAGDEVFTVTSK

SEQ ID NO: 6057 - protein, 307 aa, Lactobacillus casei
MTLSINLDQMTTETRNQRTMHLDTMSVHEFATVMNAEDQTVAPSVHQALPAIEAAIQTITTAFKQNGRLFYIGAGTSGRLGVLDAAECVPTFGVSPEMVQGLIAGGMKAMTVAVEGAEDSPALGKTDLEDRKLTANDVVVGIAASGRTPYVIGGLDYAQSVGAATISLACNAGAEISRHAEIAIEVPAGPEVLTGSTRLKAGTAQKLVLNMLSTGAMVGIGKVYKNLMVDVQPTNEKLVVRSQRIIQQATGCDAATSAKAFEAANRHVKLAIVMILTDQPSTIAQTLLNRANGFISKAVALSQEEEV

SEQ ID NO: 6058 - protein, 347 aa, Lactobacillus casei
MIGFSCYLSEPADEQQTAYLKQMQQAGFTGVFTSLQLPEDDPKTLRQRLNHLITSCRQLGLAVVADISLASLKRLGIAPRDCSGIEALQLDGVRIDDGIDMTTVAALSHTMGVALNASTLSSETIDQLANAKANLRHIEAWHNFYPRPETGLDPCWFQQKNHWLHTLGFKTMAFIPGDAQQRGPLFAGLPTLEPHRGLLPLAAYLDLKQLATDHVYIGDPQLSPRSIAAFQAYTSDQVLLIQTEAADERLYHLTWHNRPDVAQQVVRLAEARLEHIFAAPEPHHTVERPRGSITLDNTRYGRYAGELQITRCDLPADPKVNVIGHVAPAALPLLDHIGPHQALRFKQ

SEQ ID NO: 6059 - protein, 289 aa, Lactobacillus casei
MSVEGNYQSTRGELSEAEKKIVDYVLTHAQDVLTMSVYELAKAAGASPATVSRAAQRLQFAGYNELKMQLAADLNGEANELDYQEIQKDESLTTIKTKLRTNAERSLSETVDQVDEATVQTITDLIHHSRQMLLFGVGASYLSAQNIAQKWGRLGYACHFSDDLNLFLPVAATADPKRTLTWFISNSGESPEAVLGAKLAKKAGLPVIATTKLGNNSLAHYADIVIQTSQPMEAPNRFAATQSLHAQFMLIDILYYAYVSRYYDTSKKQTDDSKALVTTYKEFMRHGFK

SEQ ID NO: 6060 - protein, 430 aa, Lactobacillus casei
MGTVVIVGTQWGDEGKGKITDFLSQGAKVVSRYQGGDNAGHTIHANGQVYKLRLIPSGVLYPHQLSVIGNGVVVNPKSLVGELARLAEQGVTGENLRISDRAHVILPYHIKLDKLQEAAKGADKIGTTNRGIGPAYMDKAARVGIRMADLLDKEIFEERLKANLKAKNEEFVKVYDSTPMAFDDIFEEYYNYGQQLKQYVCDTSIVLNDAIDKGEHVLFEGAQGIMLDIDQGTYPFVTSSNPAGGVTVGAGVGASKIDRVVGVAKAYTSRVGDGPFPTELLDDTGDFIRNAGHEFGTVTGRPRRIGWFDAVVVRHSRRVAGITDLCLNSIDVLTGLDTVKICVAYERDGERIENYPASLKFLSECKPVYEELPGWKEDITHAKTLADLPENARHYVERITELLGVDLLTFSVGPDRDQTNVIANVWDKVE

SEQ ID NO: 6061 - protein, 617 aa, Lactobacillus casei
MTKAIGLYLFGVIAFIGGLWISQPLPRATLLILAAVVAGYHVIAEGVVQTIQASKAQHRFSPNIHILMALAAIGAIAIGSFEEAAMLILIFAGAHFLEEYVENKSRKEITALLAMAPLEARRYGHDGEFEVVPVAELEIGDRLQILNGAQVPTDGVIVAGTASLDESAISGESIPREKQVGDEVFGGTINGQSTFDMRVTKKSDETVFAKIIQMVQAAQQSPTKMASVIQRFEPIYVKAVLVALPIVFLAGPFLLHWSWMTSVYRTIVFLVAVSPCALAASAVPATLSGISNLARHGVLFKGGSYLANLTQLKAIAFDKTGTLTEGRPVVTNSEFAPHVDQAALTAIITAMEKQSNHPLATAIVAHFPASDLVLESVRNEVGKGLTAEYQGHTYTIGKPQRFARVDPIYRQRAKVLGQQGKTVVLVAIDRQVVGLIALMDQAKSSAKAAIAYLKHHDIQPVMITGDGKQTGEAVATDLGIEQVVTDVMPEQKVSIVKQLQEKMRPVAMVGDGVNDAPALANAEVGIAMGSGTDVAIDVADVVLVKNDLSRLAFAHRLSAKMNRIVIENLLFSMAVVVMLVILNVLQLTNIAWGVVFHEGSTLVVILNGLRLLLPQKP

SEQ ID NO: 6062 - protein, 116 aa, Lactobacillus casei
MTTNDVHTTAASDSDIPDDEGLRDILEVFKTMSDPTRMRIILAIAKGPITVNELAAMLDLGQSTVSHQLRILKQTRLVVGDRSGKQIYYHLVDDHVLEIYELTKAHIEEKQHGQIS

SEQ ID NO: 6063 - protein, 47 aa, Lactobacillus casei
MVINAGAVISTYREQTGITQQALADFIGSLKALVSTWDPGVPRAKGH

SEQ ID NO: 6064 - protein, 164 aa, Lactobacillus casei
MDFYMKLPRNKKEFALFMGIVSIVSVNIIAPLITFFESGFHLYVWRDVLTILPFIWLSVIVIVLITYIPAEKMTALIAAKDDSFRSHIVVNILCTVLMMSVFLTVIGTWIGTRAITLEPIQMFFYKWPRNFAISLFVEMCIAQPIARFALLQLHTRLDEKRQLG

SEQ ID NO: 6065 - protein, 727 aa, Lactobacillus casei
MIEFYTQIKKRDGRIVDFDASKISTAITKAAESVAELSPSDVLTIDHLTDTVTAKIRDRYHDDVEIAEVQTVVEQTLIAAEKYDWAEAYTQYRLKRDLARKQKQDVNYNVAKLVNRDKSVVNENANKDSRVFSTQRDLTAGAVAKAVGLKMLPPAVANAHLRGDIHWHDLDYTPFMAETNCCLIDFDYMLNHGFCIGNAEVEPAHSIQVAVTQMTQIIANVASSQYGGCSSDRTDQVLAPFAEKNYQKHLKEFGDVIDDPAQLKALAVKQTKKDIYDALQTLEYQVNTLYSTQGQTPFVTVGFGLGTSWIEREIQKDILKIRILGLGKERRTAIFPKLVFTLKRGLNLNPEDPNYDVKQLAIECATKRMYPDVVSYDTIKRLTGSFKAPMGCRSFLQGWTDPKTGKEVNAGRMNLGVITVNLPRIAMESKGDKDKFWKIFEERMRICKEGLLYKIERTKQATPESAPILYKYGAFGKRLADTDSVDDLFKNGRATVSLGYIGLYEVGTVFYGSAWEKNPEAKAFSVSIVKALDDHCKAWEKQYGYHFSVYGTPSESLTDTFCRDDTKKFGIVKDITDKEYYTNSFHYDVRKSPTPFEKLDFEKDYPQYSAGGFIHYCEYPNLKQNPKALEAVWDYAYDKIGYLGTNTPIDQCFKCGFKGEFTATAKGYECPECGNHDPATCDVVKRLCGYLGNPNKRPMVHGRQEEIIHRKKHITFSLNQVANRRDK

SEQ ID NO: 6066 - protein, 234 aa, Lactobacillus casei
MVANAFTASQWQSAEQWNNGWLFFAIVVILLIVNHIVIIGVYVPNRLKWKWAVIVPFIFICLGLARYSWVRTTSAANVQFNQWAKQITPQIRVKKASFFRLVPVPDSAIEAYQGLNEYPAFKTLPMYAHRQVTAPVTYLGRNANSVYFKWQGMIYRYTGTTRSGDHAALIGYRFWLKDRNYTRLGFVNPSKTFTAALMIPKGQAKRIYHPVKQIVVTLESMDGDWTTEKVYRGS

SEQ ID NO: 6067 - protein, 202 aa, Lactobacillus casei
LNFSKQLQQIRTAHHMTQAELAHDLNVSRHTVSNWENERNLPDLEMVTRIARIFDVSLDHLILDNPQLKKKLIKDSTVNHWQTVMAVLTTVVAILIGMATTTLFGFHPHWLTQAIWWLLTGTTLVWGHFIAPKTVDIFADWSVLSRRLTALGFSLLGLTLLITGLAIVWYRGISLDIILVIVGSLFMLILTKPIWPQHQPAK

SEQ ID NO: 6068 - protein, 94 aa, Lactobacillus casei
MVSKDEVVQAMERLNSALAESHPNSETAKYVLQTLKDIKKSEGVSFYATLQAFFNMGPSIKLSDDFVFSETEKALWDKIFSFKQLGNNLWGAHL

SEQ ID NO: 6069 - protein, 157 aa, Lactobacillus casei
GNATFAMILYPRTEINMKILKSTDEQEAYIEDRLEAYNEKKHPLTQERPAVVFSYTALEGQDVIGGIIGYASLYKIGYIDTLWVNEKYRHKSIGTQLLKKVEEDLRTFGCEIVHLETFDFQGPEFYKANHYTEFGRLEYPTAQVTEMFLKKDLRITE

SEQ ID NO: 6070 - protein, 326 aa, Lactobacillus casei
MDQTQKLNAPIRQHIFLIVAGILLLLLATAAGFDWQISQTIGDMNDPFATLFQDVGLWTAPLIIMISCNIVCHYALRSSQLAWYVRTLMVIGSVIYAGWELWAGYLKYAMTMVITSLNDINAGKPMGMANSDGSKLALPGATSLILFIVLYVAVFAGSQYWLSHKSDEQLRYLLKVALVATLVCIMSDQIVNAMKTFWGRFRPYELNGNPAHFTSWFHPNGANGHMSFPSGHTQTAATILTLTWFVDRDKPKRQRLVFWLTFAYGAIMAYTRVRILAHFTGDVTMSLILTWSLILILGAVAQLPLVNWEALTAHAKSKKLDTEPAS

SEQ ID NO: 6071 - protein, 355 aa, Lactobacillus casei
MIKPPKLHQHEQVAIVSLSAGTLGEAFAAHQRELGTKRLEAMGLVPRFMPNALRGQAYLKAHPEARAADLKTAMTDPDIKGIICAIGGDDTYRIVPYLLDDPEFIEAVKNHPKIFTGFSDTTIDHLMFYQLGMTTFYGPNFLNDLAELDKQLLPYTAASFHHFFENPATTAITSSPTWYEERTDFSADQLGVPRKAHHEQHGYLTLRGHGRITGTLLGGCLDSLHDLLYPVRYSDEPQVAEKYHLFPQSWADKILFIETSEEKIDPTTYRQFLRHLDDHSVLQQVRAILVGKPQNETYFTEYQQVLLDVTASYQTPILYNLNFGHAYPRTILPYGLKATVDFDQRQLTIDEPYFA

SEQ ID NO: 6072 - protein, 83 aa, Lactobacillus casei
MYTIQTAATVGARGTVITIAPPIERIRPGDPIRLNGKRIGRVRAIEKANHPHHVNDKPCTGLVITIPVKPGDTIEFPQSPRKS

SEQ ID NO: 6073 - protein, 361 aa, Lactobacillus casei
MKIVVLAGGRSTERNVSISSGYRITNALRQKGQQATFIDLFLGYDLEGKTVDQVFDDANTSKDLKISDAILTDADINKLRTDGSTQLFGPNVLAICKAADIVFLALHGGDGENGKVQATLDLNNVKYTGSGPLASGMTMNKVFSKEIMLYHGIQTAAFKEFKRNQPGEHKVPFDFPVVVKPTSGGSSVGTHIAHNQEELESGIADVFRFDNSAIVEEFTPGREFSLGVVNGRAFSAIEIKVHSGWYDFKHKFQAGYTDFITPPKDLDEDVHQAMKDVSLQTMDVLGLQNYGRIDFFANDKGVWVIEANNLPGMTPLSLLPQEAEADGVEYGDLVMDIINGKLKLYADGMTEAGIMTAASAD

SEQ ID NO: 6074 - protein, 163 aa, Lactobacillus casei
MQYSWLTMPQHRYLLVADQGKLIFVGSPDADLQEAEHYVDGPFEFNDEAMEPFQTALTAYLTGKTKAVTVPVAFHGTALQQAVWQYLLTIPYGATRTYAQVAAGVGHDRAFQAVGHAVGQNPLMMVIPCHRILRKDGGLGGFRGGLALKRKLLALEQGERPLF

SEQ ID NO: 6075 - protein, 333 aa, Lactobacillus casei
MKIIAYGARVDEIQYFKQWAKETGNTLEYHTEFLDENTVEWAKGFDGINSLQTTPYAAGVFEKMHEYGIKFLAIRNVGTDNVDMAAMKQYGIRLSNVPAYSPAAIAEFALTDTLYLLRNMGKVQAQLHAGDYEKAGTFIGKELGQQTVGVMGTGHIGRVAIKLFKGFGAKVIAYDPYPMKGEHPDFEYVSLEELFKQSDIIDLHVPGIEQNTHIIDEAAFDLMKPGAIVINTARPNLIDTQAMLSNLKSGKLAGVGIDTYEYETEDLLNLAKHGSFEDPLWDELLGMPNVVLSPHIAYYTETAVHNMVYFSLQNLVDFLTKGETNTEVTAPAK

SEQ ID NO: 6076 - protein, 299 aa, Lactobacillus casei
MTEYTKGQLIKSIRVSRGLRISDVADNLSISTISKFENGQSDISLESFSQLLKNLKVDPAEFCELLSDLRESQLPITDISNDSFEDRISRLSLEQDVTALHSYQLQLERQYTKTNAPFYKLRAIVVTATIIKIQHPHSFLSKPDAELVKAYLLQQDTWYRLEYMVYNHCVPFIQTTIFEQLYPRLLLIHFSTKKHQNQQDLFSEALYKTASSLYHRHKYADALTALDRLNEQHLPEAYFFIRLQSNLLKKLCQFKIMGSKFAEEDVNSLLKATSKISPAIGQKWRTAFNTTLEVNVEDH

SEQ ID NO: 6077 - protein, 198 aa, Lactobacillus casei
MAKSKQLTVAIVALASVAGFSFSQIEVNHVAAATTPSKSNVASNTASTSGIDPNNPVLPDQSKTRYIDDSQVLETLKAKNPTAYNKIPQATIDSIENSGLLRQGGTYAKVTSDGITIYINSALVTVAKIAGTAAISTALASVLDVEEVGKKSAVFITSSMTGILDQFSAERGIWMHFTNYDPGSTGEGNLLLSSCGQQ

SEQ ID NO: 6078 - protein, 74 aa, Lactobacillus casei
MVGVAKIKIKMTTPKLVGICVIIGALIGVIAKYLANLVANSVLEWAIKIGALAVGGLAGYELWNHFENKKNSKL

SEQ ID NO: 6079 - protein, 116 aa, Lactobacillus casei
MWLWLHLISWAVLAVAAGIAIFSHTRQFVMWTMIARVCYLVSIVTGVVLMRFAFDRNPLLTVVKILLAIGLIGLIEVAFAGKKQQHLSKAILWSALAAFALVTVTGFVLAQFRPFV

SEQ ID NO: 6080 - protein, 485 aa, Lactobacillus casei
MENFFHLKQNKTTPMTEVMAGLTTFFAMSYILFVNPQVLSQTGMPAQAVFLATIIASAVGTLVMGLFANVPYALAPGMGLNAFFTYTVVFALGFSWQEALALVFICGVINILITVTKIRKLIIVAIPETIQHAIGGGIGVFVAYIGIKNAGFLQFTSEASSINTINGQPLKAGALTLKHGVESVVSNGGIVPALVNFTQAGAVLALIGLVIMVILNVKKVPGAILIGILLTTIIGIPMGVTDLHLSAANSFGSTFASLQTTFGAAFSAKGMGSLFTNPDKIVLSIMTIFAFSFSDIFDTLGTFIGTGRRTGIFSDADEHALEEGSGFSSKMDRALFADSIATGVGSIFGTSNVTTYVESAAGIGAGGRTGLTSVVVAGMFLISSIFAPFIAIVPTQALAPALILVGIMMMSTFKEIEWEDLSQAIPAFMASIVMGFVYNISYGIAAGFIFYCLIKLITGKAKEIHPVLAVVTVGFILNFVILAAL

SEQ ID NO: 6081 - protein, 107 aa, Lactobacillus casei
MALKAIFHLDTTGRWPHLASNLTNFLTAEPNADLEVLVNGDGITVYFDQEVVDFIAAHPQVKFFACHNSLAQRHLDEKQLPATVAIVPVGVVKLAQAETAGYAYIKP

SEQ ID NO: 6082 - protein, 324 aa, Lactobacillus casei
MPNQLTGLHHLTAITSSAPRIFHFMSGILGLHLIKKTVNQDDVRTYHLYFTDDMGTPGTDITFFDFPGIQKAQHGNNEIARTSFRVSSDDALNYWVKRFDEQRVRHDAITELFGAKILPFHDFDGQQYQLISDEHNHGIPAGTPWRHSPVPPEFAISGLGPEYITTDHYEELIGIMTDLLGFEKIAKDGQYTLLELNHGGHGAQVIIDYQRLIPAAYQGFGGVHHLAFRTDDRDSLHYWIKKIGGAGLDASGFVDRFYFASEYFRPIPELLFEIATDGPGFLLDETYEQAGVHLELPPFLEDQRAAIERNLVPFNTEPQPAEKL

SEQ ID NO: 6083 - protein, 98 aa, Lactobacillus casei
MFNFLDNPDEYKRLMKMEILITVVAVAASVVLFNFGVLTGALFATIAAAFFLMDAIVEGLRLLGASCGFSRFIGTAVAIPALAGYLMVMIARFPIGIA

SEQ ID NO: 6084 - protein, 191 aa, Lactobacillus casei
MQSFEKYHPIMSVHYTMDWLTTFKIKDVFQLRADQQIAAESGRQFDQRITDTARYINHSMRLVMSNNALLYGIKDRSTNDFLGSFCIWNFSEKKTVAQIRFETLAAYQGQGIMSEVLKRMIGFAFFELGLKRVYVILPASNDRAAKLLTDNFFTQVGDYRHERTLPDGSKVPLVRYELTAEAVADKEDFHF

SEQ ID NO: 6085 - protein, 641 aa, Lactobacillus casei
MLLQPLTLNVGSQAASSTPSPVLNEASVSQPDQQAPSTSAESKLETSSEASTSSNQAIASSTSAASASQPIASDTTHEALTDQADDSATPKRRQKRAVQATSSTQSSPFLVGTAQELAAAIKSGETHIRLTADINIGAAAIPVRQSVIIDGDHKYTYMYNGGLNWHRGIYFAASGIQITFKNIKIGKASVKHSANNYYGIAPADNSIKNSQIIIENVDYYSDYGAQPIHIRDKSNQIIFRGKNNFYTTKNPGSILIQEFAEATNFLFEEDSDTTITLAKGEVLGTFWPSTGPLNLELKKRARLKVDTTNALVYTGIGAIHNNRIVIGEEAVLDVKTNRTNAGNLMFYNHDLTIDVQRNGQLLAETVSATNFNSNSSINLGPGAKANLKNVNGDFFKKGKGTITLDNADELTLETGKCGGTSPTGLVSSKANVRLEPFNQETKGYGVHADGQLLTTQTGDDDWIFNGKHVSRQPTALPTDVANQVGNASVFKLKRQLVPKPAGKLAVISVPDLDFGSQTVTGLTQILRPRVQGSLKIEDSRTNGSQKSRLYLRMARPFKNGNVDATRCLTYTNQAGQEQTLSSQAILAEVNVGVTERDVSSEWNTAIDSSARGFKLTLPIEKQKIGSFSGELDWSLQDVPGN

SEQ ID NO: 6086 - protein, 116 aa, Lactobacillus casei
MKKWLPLAVLLLGLACHPRLVAIADSQYTSTGEVVFVEPAASEPEQPSAAPSAQASSHQQHQPPATSQAPPSRSGLVPRLGERPEILYGLIGSLLIVTMLLFFIIKQHKEDKEEGK

SEQ ID NO: 6087 - protein, 255 aa, Lactobacillus casei
MKKSIWTAPLLGLTLVGLVAPAAVNAASANDMISNGEVTFKADNSSTGPKDPLDPTDPNPIKPIDPSNPGGNPTPGTSGPLSLDFASSFTFGEAAISSDDAKYYAKPQVFTQQDGTTVDRPNYVQVSDKRGTFEGWTLKVKQDKQFAVKDDATRELIGAQLKFKNASLVSATDSKYAPTGLASFELIPGTAQIAPVEAVKDQGMGTWIYRFGDDKQMGRSVELSVPGKTPKMAKAYVTALTWTLESTPANVTPKP

SEQ ID NO: 6088 - protein, 361 aa, Lactobacillus casei
VKKILFCLAAFVAMLLTPAVHVFGSELNFAAKAQLPDNQVHTDVSYFDIKMDRGAKQTLHVDLRNDTENEVEVDVGIASATTNINGVVEYSPNDIKPAKSLAFNLKDHVKAPSQIKIPAKGNTILNLDVTMPDAALKGQMAGGITLKEHQTEDQANEEKGKGLSINNRFSYVIGLVLQQTTQPVTPDLKLNTVKPSQVNYRNVISASLENITPTFINKVAIDANVHAKGAKKVLYRVKKEGMQLAPNTTFDFPIALAGKALEPGTYIAQLEVYGNQSSDGKVTRQTNSAKQRYQNHWTLTKEFTITDHTAKNLNQKDVTLKSTNHWWVYALLAVVAILLIVIVLLVIVLLKRKHKKSTERE

SEQ ID NO: 6089 - protein, 483 aa, Lactobacillus casei
MRLSELMEKNDQKKLQLLHYLDQHPNQRLRNSELQHKLDISYYLFKRRTKEIADDIDTFQLSGLFDIEVTDTTTTLHKNHNTNIFVFLNHYLERSYQIKILMLLVMQRQNFDLYDFAEAHYVSYTFMYKRFTALRQTLQKWGINLNNNSELTGDELAIRLLLAELIIITHVGEETFDNEIRTALHELLELIDTPAIAPSMSQLIETKAYLLASLLRFQQGYFVATSPEVAKLISKIRQQALEERSKVIAIFQTHFPADEQAINNECDYLGTFLAIVGIISAPAVIFPDEVTQRSSDFIRGFEERFGVTLTLEAKQNITYEVDKCWIDVVAFPLRSGFFEYHTEIAYFARTFPEFFEYCQTYVQQQEAALDDQQAQFIFYRCLLTLVANVPLSSVLEPLYVCVDFTLGEAYNTIIERGIKRFSMLNVKVTNEVQPKTRLIITDLVNAYRHTDIPKVIWLSPPRAEDWEHLISELLAFRLVPNGV

SEQ ID NO: 6090 - protein, 327 aa, Lactobacillus casei
MERENGFWPAIKDFFFRAGDFKGVSSRAQYWWVFLAQILVGVVAGVLIGVTGPAILNGEKSFGASLLQTLVMLPAIALGYLGYPQLSLTIRRFRDAKVSPWLYLVLVIVALAGPLMAASGMGLLPLFILPIVAALVTLIILVLPSREQEVKPFPVQPHSPSTVGVGFGAAVKNLFLRGGDFTGTSSRSQYWWSILFSVLIMVPTGLFVILSLVATFVGVAAAGKIEPQNAAHIFNSLGFGAVILVVLFLAIFYAWSMLSLPMLTVTWRRFRDAGISPWWFVAFYVVSNFVSALQASNKNLVLTLIPLILVIVQIVILALPPKNLGDQ

SEQ ID NO: 6091 - protein, 109 aa, Lactobacillus casei
MAQPPSSLEGFPKGEFAAFSTAKMTHFLPYSQDTTTKDLKGFFGTNFQYLTKTPIGRLKIEIPNTEPLIVQYGEIIARFTNGKFKVIDSTYFHKNFNDPLVDEDSKGIY

SEQ ID NO: 6092 - protein, 448 aa, Lactobacillus casei
MDQSLFQNGNFQPLASRMRPQTLDEFVGQTHLLGKNKVLSNLIEHDEISSMIFWGPPGVGKTTLARIIARRTKAQFVTFSAVTSGIKEIKQVMKEAEQNRELGQKTIVFVDEIHRFNKAQQDAFLPYVERGSIILIGATTENPSFEVNAALLSRTRVFVLHGLTSAELVDLLQRALKDPRGYGLQKVKISKKLLGQIADFANGDARIALNTLEMAVTNAETKGDVVSVTQADVAQLLTKKALLYDKNGEEHYNLISALHKSMRNSDVDAAIYWLARMLEAGEDPLYIARRLVRFASEDIGMADSRALEIAVTVYQACQFIGMPECTVHLTHAVTYLSLAPKSNALYTAYGAAKKDATETLAEPVPLQIRNGVTDLMQDLGYGKDYQYAHNAKDKLTTMQTMPDNLVGRTYYHPTDQGSEEKVKERLEQIKAWHAQHPTPTPPDTKEKS

SEQ ID NO: 6093 - protein, 396 aa, Lactobacillus casei
MAKILAVNAGSSTLKWKLFDMPAEVQLAEGLVDRLGQPQSKVKIKYGDGQKYESDTPIANYQEAVASLMGNIKSLGLVEHLHEIIGVGHRVVAGGEVFAESVVVDDETLLQIQNLRDYAPLHNPVEADYIAVFMKMMPWATEVAVFDTAFHQTMQPENFLYSIPYDYYKKYGARKYGAHGTSVRYVSARAAEMLNKPLEDLRMIIMHLGSGSSITAVKDGQSIDTSMGFTPLAGVTMGTRSGDIDPSLVAYLMKKLDIPDVGQMIHILNNDSGLLGISGLSNDMRDLEAAEDTNPRAKLALDIFVNRVVKYVGSYAALMNGVDALIFTAGIGENGDEIRDKIMRSLGYLGAKIDNDLNYKSHGVETDLSTPDSTVKTLLVPTNEELMIVRDVMALS

SEQ ID NO: 6094 - protein, 250 aa, Lactobacillus casei
MVSFQRQEQILKILNTQQFARYSDLAKQLFVSPATVRRDTLDMENRGLIKRVLNGVTLSEEPEDVPYDYSVTLNLDAKRTVASRADRLIKSGMSLFIDSSTTALVLIRELSAIDELYIVTNGILVALEASKHNGWHVNLVGGAVNKMLENISGDRATRDIENYQADLAIFSCRGLIAAGATDANDQEANIKRAFAAHADQVMLLVDHTKVGKHQLYMSAPMNTLDYIATDKAMPEDIVSTARANHVQIFD

SEQ ID NO: 6095 - protein, 498 aa, Lactobacillus casei
LALMGLDLGTTGVKSTITDNQGNILSAAYREYETSVPREGEYELDPSVVWSATKEVIQESKKFVKEDVLAVSVSSFGEAFVAVDDQGQPLMNTMLQTDSRGKDELKDLLTRISAEDIRNKTGLNPAVTFAVPKIMWIKKHRPELYGKIHRILLYGAYILYKLGNVDAIDYTLADRSLAFNVSTNDWDSDILAAAGIDRKLLPKCYRLGTVVGTIKPELASELGINADMKLVTGAHDQICVSIGAGTIDVGDATDGMGSVDNISPIFTDTSHLKENAKKNYPTVPYLDNKYTTIAYMYDGGTSLKWYRDTFGFEEVQAAELSGVSVYNIFDKYVPKKPTNLLVLPHFSGAAVPYFDEDARGMILGLSGATRKPDIYRALMEGVAFEMRMNLDNMEAGGMHVNHLRATGGGSRSDTWLQIKADVFNREVGRVHMKESGTMGVIIMAGVAVGLFDSFETAMKKLVSIDKVFKPIPENVAFYNHQYKKYQQLYAFGKKLRSL

SEQ ID NO: 6096 - protein, 289 aa, Lactobacillus casei
MVLVNTKEMIKKAKEGHYAVGSFNVTDIEMIRGIVGAAEKENSPVIIQFAELHDKYVPLDVIAPVMLNIARKASVPVAVHFDHGETFDNIMRAIRLGFTSVMVDASQENFADNLAQTKEIVKICKPLDITVEAELGPMNREGSGDKKVDYADLDKTYTNPQEAKQFIEESGIDMLAVAYGTVHGVYTQKPHLSFSRLKEISDLVNFPLVVHGASGLTDEEYRKSVENGICKINYYSEMVHRVALGVQKKLEQDDSDKQLFISDASIWETEMVEKEIRGRLRVFGSAGKA

SEQ ID NO: 6097 - protein, 445 aa, Lactobacillus casei
MKFLVDMLSQPSIIAGIVVCVGLIALRKPFTEVIGGTVRAFIGFVVMLAGTNIIVGALNNFAKLFTKAFNMHGMIPSNEAAIGVTVAKYGTVATFIFVFGLVLNIVLARITKFKYIFLSSDHAFYMACCLTPVMLLGGLNTLEAIVFGSMTLGVILCVFPAIAHPTMKIITGRDDMSFAHFGTLEYWMSAKIGSLVNKDKKSKSIEDINFPKSLAFLQDSNVSVTIVMTILFFVVTAVAGPAYVGKLTNLNPYVWALLQAAQFTAGIIVLVQGVNMLLAEITPAFKGFSEKIVPSAVPGYPFAILFKGTSNALLAGFLVSLLGGLLSMGVQILIGTTIVIPGIVMHFFCGGIAAIFGNATGGRKGALIGPFLGGIILSFLPLIATSLYGGLGYTTTYWSDSDFNTIGVILGLIAKVGKWPIMIAALIIFAFPFVFSALHKKKLVD

SEQ ID NO: 6098 - protein, 273 aa, Lactobacillus casei
MTMIVVSDIHGNLKTMDRVRLMQEKYPHVLTVYLGDYIDGYPYGGRVLAQIHEQVQDSQAIAVRGNHDQMLLDYLADKDNPWFINGGKATLRQMVKDFAPTVKGMSLREAVRTHMAPLISFIAEMPTAIAFDKLLLIHAGLDFSLADPLKETTPFNRMWVREPYIYDMKQTQSRKHPIFAHNPLNKTMITGHTPTALIYGEYEDQVKPPIAETTFTGGYPKCPVKVIQYPGESPRYFIDGGNHMGFKANYGNICVFDETKGVMIDSDQGINAE

SEQ ID NO: 6099 - protein, 239 aa, Lactobacillus casei
MDKRLIVMHNLSRHYGKQYWWQQNSLEDWLMMILIQRTSSKNVAQAVHNLRPYMSVKQLLALSQAELEELVRPAGFYRQKAQRIHDLLVWFVAQGGSFTEIAKKPTEQLRKTLLALNGIGNETADVMLMYTFGKKTFVADTYAMRLFNRLGFGPYTNYAKMQADFAPLLADINLDDAREWHALIDEHGKTQVRHAYDDHFLLQPNLTEDQWPPEATQVEPPHDDPGSGKWRHAEESSNE

SEQ ID NO: 6100 - protein, 98 aa, Lactobacillus casei
MNASIAVQVLPMYPDQKKVLEVVDAVIAYIQSTGVNYEVSAFETTMEGDYDQLMAILKQIPVVTAKAGGTSQMVYAKINYFSEDTGLTIADKVDKFKH

SEQ ID NO: 6101 - protein, 482 aa, Lactobacillus casei
MATTTKPQGRGLVMAAVFIATFMTSVEVTIVTTALPAIISDLHGLAYQSWIMSAYLLTTAITTPIYGKLADAIGRRGIFQWGVVLFTVGTLLSGLAPHILLLILARALQGIGAGAVMPLTFTIIADYYDFAHRANVMALNNTAWGLSALVGPLIGGFLVDQLSWHWVFFVNVPLGMLVFFLIQVGYREPSRKHVSLTIDWLGIAWLAVTLIALLLGIQALDQQPWLAALLLVLACVGGYLLFRQEQRATDPLIAPQMFQSFTFTVQILTALLLSGVLIGYQVYFPIWLQSLYHLGATAAGLVVTSSSVLWLASSFLVGPLIKRFVPRTLSLMLVFILTCAYLLLTVASPNFPVWAFYVIAMVNGTVMGIVISMNTVLSQHLVPDRYVGSATSILTLGRSLGQTVMTGVYGAVLTLVIRANLHGLSFKTVNAAISAKSTTSVHNPQAAAAILTGLHGVFMMVVVMMVLVLIINWRDPNRHIIQ

SEQ ID NO: 6102 - protein, 56 aa, Lactobacillus casei
LSLSQIDWLLLFFALVGALSLILFDQILAAAVIIILMASAIVVDRHMPRHPRRPAL

SEQ ID NO: 6103 - protein, 48 aa, Lactobacillus casei
MKNHFLKTFVAIAAVGAAAYCLKRFSDELVVYVSPDKDAGDKDDWTDF

SEQ ID NO: 6104 - protein, 793 aa, Lactobacillus casei
MDTKVKTVDYSSKEYFDRMTEYWQAANYVSVGQLYLKDNPLLERPLKSEDVKPHPIGHWGTIAGQNFIYTHLNRVINKYDLNMFYIEGPGHGGQVMVSNSYLDGSYSEIYPRISQDKEGMKRMFTQFSWPGGVASHASAQTPGSIHEGGELGYALSHATGAVLDNPDVIAAVVTGDGETETGPLAASWFSNTFINPISDGAILPIVHMNGFKISNPTILSRKSDEDLTKYFEGMGWKPYFVEGDDPTKLNPEMAKVMDDAIETIKAIQKHARETGDTTMPHWPVIIFRSPKGWTGPKSWNGEPIEGSFRAHQIPIPVDAEDMEHADSLAGWLKSYHPDKLFDENGKLIPELAALPPKGDQRMAANPITNGGIDPKPLVLPDYRKYALDNKEHGKQIKQDMIVWSDYLRDLIKLNPHNFRIFGPDETMSNRLYSLFEVTNRQWLEPIKEPADQYLAPAGRIIDSQLSEHQSEGFNEGYTLTGRHGLFTSYEAFLRVVDSMLTQHFKWIRKAHEEPWHKAYPSLNVVSTSTSFQQDHNGYTHQDPGILTHMAEKKPEYIREYLPADANSLLAISPKLFGSQNTVNVLITSKQPRPQFYSIDEATVLANAGLKRIDWASNDDGVEPDVVMAAAGTEPNMESLAAINLLHDAFPDLKIRFINVLDLLKLRSPEIDPRGLSDAEFNSYFTTDKPILFAYHGFEGLIRDIFFTRQNRNVLIHGYREEGDITTPFDMRVLNELDRFHLAKDVIQHVPAYAEKAAAFIQKMDDTLQYHHDFIRANGEDIPEVQEWTWKPIK

SEQ ID NO: 6105 - protein, 539 aa, Lactobacillus casei
MKVKRLVAGAMIFASTVLLAACGSKSSSSDTFNRMEKDVISTMDNAHITDVVSGQAAVDTGDGLYRYKGKKLQAAVATKVVKPTNNGLTYTFNLRKTKWSNGDPVTAKDFVFAWRRATDPKTKSEYAYLFSGIKNADDITAGKKAPSTLGVKAEGNYKLVVTLDHPVPYFSTMMVNPVFFPLNQKTVEKYGKKFGTQSKYLVFNGPFKLTNWNGTGNSWDEVKNDSYWNAKQVKLKKIHVQVVKDSNTAANLYSTKKLDDAVLTGEIAKQHKNDKDYVGDKQGRTTYLDMNEDKVPDFKNTKLRQAVSMAINRKELADKVIGDGSFGIPTITPENSGSNPKTGEDFAKDAAKESETVQKYDLKQAKKLWAEGLKEVGKTGEQVTLTTDDTDVAKKTGEYLQSALEQLPGMKVSISSVPFKTRIQRSLDGSAQFILSGWQGDFPDPISFLDLYSTGNTYNFSHWSNKEYDDLLKASKNADANNETKRYDDLLKAQVLLSKEAPVATLYQTVQGHLRNPKLKGETFSPANMYNFVGAYMAK

SEQ ID NO: 6106 - protein, 182 aa, Lactobacillus casei
  misc_feature (4)..(4): Xaa can be any naturally occurring amino acid
NDIXDMAINPRTEINVFVALMVIEEGDVLVQEKDDLRFQLNPHAKFDVRAAVLLIHDDQVLVTVEATSGSAIVPGGAVKFGETVAEAAGREVYEELRLKDMQPSLVGVLESFWEQPEQTYQQLILVHRLELSSAQAEAVVWQEGLQGQWLSFSEASRRMRPHALAEFMRPSETFLHLVDHHK

SEQ ID NO: 6107 - protein, 377 aa, Lactobacillus casei
MDITTRPTLQQFLADTKQGPYVSLYLSWPDNTPVEELRIRFKNMMKHAKAVMGETYPKTDFAPYAAKLEPYEQDPMFWQTCETNGIGVLTNGTQTYVTPMYETVDDVAMVTELPQILPLMLDEATATDFDILALNADSIKLYHNHGHQVRPVSLPDDAPQTLTGTLGTEIRGGELNSVPQGSGHVTYHGHNDKSAEKASDQRRFYQAVDQYLLAHYSNPNKMPLVLMGLAENVAVFREISKNHHLLPKLAVMKSPATLDFVELDDLLAPIRETLRDRRRQRFAATIEKARSNDSYTEELTTIVTAALRGQLAMLFVQAGARIHARLDGERIERESKVAQHANLLNTLADIVLGHGGQVVVLPEEQLPAKVGAMMRYA

SEQ ID NO: 6108 - protein, 526 aa, Lactobacillus casei
MKPTISLLSRQKALTLLTTLLILIESLGKVASSLTLAPLTDQLINKNFNGVVFWLLSTITIWGVTLTIGYVNSVLKAQIIRKVTNQLRTDIADGLSTVSIPEYKKVNHNEYVSWLTNDVNMIEQNGLDAFFSLLGNVTTLLFAITSLAFYHYSLALAAIILGLLTMTIPQFFSKIMTRETNRLATANSSFLGKADDIIGGFSVFFSHNLGNAFTHKLAVASDQQGKEKVLYTKNVGLVNLLISGVNVTAQMLVLALTCLLVVGGYFTVGVISSSGSLAGTVFNNLAGMIQGIFQMKSVTVLLHKDTSSKEPALSSEDDSFKNALTVDHLSFNYGEKPVIKDISYRFEKGGKYAILGKSGTGKSTLINLMSGRLTNYSGSIHVDDLELNSLPASMLNAKIELVDQKSYIFNESVQENITLGKPSASNALNKIVEFLGINTFTSLSTNIHEHGSNLSGGQRQKLALARALSFRKPILIVDEVTAGIDDESAQAIEDALLAEKDLTVIMITHHLTPKTKAQLTGTLELA

SEQ ID NO: 6109 - protein, 288 aa, Lactobacillus casei
MEKIGEVIHIFRENKGMSQAELSDGILSKAQLSKFERNLTQISADKLLALLERLHVTFAEFGNALAIQENLYEQSILEDITKAIVNNNGGQAALVEDRAEAHFKNHPGKYNRLILIMVKAMIADMNGESLSKTDASFLADYLFNVDGWTRFELLLFGNTLSVMPLVTVNQLARELASQLNEALEIHQNLQLNISLLYNVVLLNLAAKDLKTARLFLRVMKNSHIEDNMMAERFLIALAEALCTYCENPSSENKERVEKIVEIQKTLGSTSFFVAFKKQAEMFINETTP

SEQ ID NO: 6110 - protein, 616 aa, Lactobacillus casei
MHITLIGAGPRGLLLLSRLLSWQPTRYPKRRLNIVLVDPYPIGGRVWKINQDPNLIMNTAASQITLFTDQSVTDVGPFITGPDLSTWALTIAAGYLDAHPELDNRAILLRQAASLGLNSYASRALYGVYQQWFFDLLRAQAGQNTITYKQQTVTRLDQKDPGFTITTDQESWQTDQVVMALGNLKNSLTRDQKALHDYAKTHKLFYLEPGFPEEGDLSNIEPQAPVIVRGLGLSFFDLMSRLTEGRGGRFQKTADGLLAYHPSGREPHIFAGSRRGFPYRAKGHNQKGPGEEWQPQFLTPEQINAWQARGEVSGQTFWEGLKHEAELIYYRLLLPQRYPDIDETAFERDFLADPVATLGALPIAAKDRLDWDVLADPTKAHPSGQPYQDFMRHYLRQDAREAMRGTKTGPLTSALEVLRDMRDPIRQFVERGLFSQDQYLDFFLRWFNSLNDFLSIGPPALRIDQLQALIGAGIVTILPPGMQIKGIDGQFLLKTPSDPKFSLQAKALLEARVPAVNAPTAQDPLVQQLLHDGYAHPYELQLNADKRFQSGAIAIDRRTQQLLDANEQPQAGLFFWGVPTEGVHWLTTASPRPLVNDVSLKTAEQIVKAIFAGAGS

SEQ ID NO: 6111 - protein, 463 aa, Lactobacillus casei
  misc_feature (5)..(5): Xaa can be any naturally occurring amino acid
NADHXIDASEMLMKVVVVGCTHAGTAAVRELLTRHPETEVDVFERREDISFLSCGIALYLEGTVGRLEDMFYATPASLEALGPKVHVHLKHDVLSIDAVDHQVVAEDLATGQQQHYQYDKLIMTTGSYPVIPPISGVSIPRVLMCKSYDDARKIKESAKDADKIAIVGGGYIGVELAEAYSRNHKQVILINGVSPLLSHYVDLPLSKEIASVLTKRGVELKTNTIARHFDSDEKHVFIQTDQGEIQADLAVVCVGFRPMTELLVGQVEMNPDGAIHVNDYMQTSNPDIYAAGDAVAVHFNPTGKDAYAPLATNAVRQGKMAGANIFGPNIKYMGTQATSALKLYDHSLAVTGLTLAHAKRNHLPAASVTMTDDFRPPFMPHTVKITMVLVYDTRDRRILGAQFYSQYDIANAANLISVMIQNRNTIDQLAYVDMLFNPNYDKPWHYLNLLGQLAVMQADNAKL

SEQ ID NO: 6112 - protein, 210 aa, Lactobacillus casei
MNAWNLIGLSAWVILIAYFIFIVWHIRRRHIKAIVKSGRQVPASVVLVDLAEVAVLFLATAGLVWASWLRPIDYRDSHAVTISHSAQPLILQTGDEHSFYVRVHTGNGKNPILYYTYWTEGAKYENNSHNAEVSSGAQPLTPRAAAYPWSKKYLKRLDQTADQAYVATVTARYQPGFLNGLGMHVGHIADRFSILRVPNDTFVEIDPVED

SEQ ID NO: 6113 - protein, 438 aa, Lactobacillus casei
MHRHSWWLVPLLLLLGICVATLQPVQASSGKWYRDQGAMMGPESRRVLNQLNDQTFAKVKGHPQIAVITVASLDDDDIEDYANDQFAKAGVGKKDWENGLLLVLSRNDHKYWLEVGYGLEGVVPDGSADEIVTDSVKNQLKAENYDRAIAMFLTNIGKRVVAHQSAITTPTQIKEKRARAAAIKQALMIAALILGGLMVLFFLAHAAMNARLHDAMSDPGAMAALPIYAAVTAAGIKLRVDSASLPLFHFAWAHDQLRVIGMAGLARRRFESWTQEIRFTTPHPYWYYHNLQGALRELSDQEIVNVPTITALADLLTPALTERLATGKPYETAYATWLSGQKSISSQEAATTWTKFLENVKATDHFSDKTLAATFSAILFHIRHPDKDQHLDQDDLPLWVMSDFGSGSSSSGGSGGSDSFGSGFGGGSSGGGGFGGSW

SEQ ID NO: 6114 - protein, 275 aa, Lactobacillus casei
LLMGTGLLGGILGAVLGIGGGMIITPILTMLMGLPIQYAIGASIVSVIATSSGATIAYLKDEMLNLRVAMFLEIATTVGAVLGAIVTGLVDGKVLYILFGALLIFSAFNMIRKMRMKEDEARQTTPDEIATKLRLNGAYFDKATGKEVNYTVTNVPGGFAMMFGAGIASGLLGIGSGAFKVIAMDTIMHMPLKPSSATSNLMMGVTAAASATVYYFGGQLQPQIAAPLAIGILIGATVGSRVMQILPTKVLRMIFIPVIGYMGIQMALKGFGVSI

SEQ ID NO: 6115 - protein, 124 aa, Lactobacillus casei
MDNKLKTEIDDVEIMIGKVMQVGVILSAVVIVLGLILLIATGSTGYPAGVHPTRVGAILSGTFALKPYAVLMTGIFLLILTPVLRVVVSIYAFAVEHDHLYVWITTAVLIILIGAMTIGYLGNR

SEQ ID NO: 6116 - protein, 541 aa, Lactobacillus casei
MSFFTNPNNPYPRSRKSVYAKYGIVGTSQPLAAQAGLRILQQGGNAVDAAVATAACLTVVEPTTNGIGSDAFAIISINGQQYGINGSGPAPQNLKVADLQAAGLTEMPKFGWTSIDVPGAPATWAAMVERFGQLSLAKDLAPAIAYAQDGYPVSQTIAYFWERAAQNYRQAQKKAANPAIFDEWFKTFCPNGHAPQTGEVWQSADQADTLTRIGQTQARDFYEGTLAQKIATAASQNGGYLTAKDLAAYQPAWVTPLKLHYHGYDVLELPPNSQGVVALEALGLLQGRHFTNRDSFDTVHHQIEAIKLAFADFFKFAGDPRAMQLDPNQLLAPDYLASRSALIGESARPPEAGDPQSGGTVYLATADRDGNMVSMIQSNYMGFGSGVVVPGTGIALNNRGNNFSFDPASPNVLEGGKRPINTIIPGFLTKNGTPIGPFGVMGGFMQPQGHLQVLMNTIDFGLDPQAALDAPRWQWMHDQTVQVEREVPAVTVNRLVAAGHHIVVQSEPNVFGRGQVIWRNPETQTYVGGSESRTDGAMAVW

SEQ ID NO: 6117 - protein, 312 aa, Lactobacillus casei
MGHFILKRMLQLVLLLIGVSFIVFFSMHLAPGDPARIMAGPAATKSDIAALHRSLGLDKPIVVQYLDWIGKVLHGNLGTSYQTSQPVTQAILSRLPTTIKLATASMVLALIIGIPLGIVAAIKHNTWIDFTSTTLSLLGVSIPNFWLGTMLILIFAVMLHALPIGGMSMHWYTVAGLKELILPAIALSAGSAALIARTTRATMLEVLQQDYVRTAKAAGLRPWKIILTHEFRNALIPIITVIGINFGTLLGGTIVTEQVFTINGVGRLMINAISARDFPVVQGTVLFIATIFVLVNLVVDIIYAKVDPRISY

SEQ ID NO: 6118 - protein, 307 aa, Lactobacillus casei
MERNISAASSKVVTAASESKINATVKSEVRFLRVKRLLHNKLAVFGLIVITLMILVAIFAPVLAPDSPYKQDLITGKNLGIGAPGHLLGTDNYGRDLLSRVIYGARISLGVGFSAVAIGLSIGVVLGLIAGYFQWLDGLIMRCMDVLFAFPGILLALLIIAILGTGIGNIVIAISIWAIPTFARIVRGSVLAVKNEEYITALKSEGARAPRIIFKHILPNCMAPIIVNATMRLGSAILSTAALSFIGLGAQPPSPEWGAMIAEGQSIMWDAPQVAVVPGIAIMLVIFSFNVFGDGLRDALDPNAKIR

SEQ ID NO: 6119 - protein, 511 aa, Lactobacillus casei
MTKKTSKWLLVSVLTALLTTLIAFGTGPTNVTAAAGRTLVYGSTADPKGLSPLSTADTVSSNVIQQVYETLFRQDAKTLKAKPWLAKSYERKSATDWIIHLRTGIKFQDGTPFNAAAVKYTFDQMKDPKRAAPRASLLEPIASTTVVNDSTVEIKTKYPYGPFLAMLSHPNASIVSPTADKKGKLNTHPVGTGPFKFKSWTTGDSVKLVRNTDYWGKKPKLAGVTFKTVPDYATAVSMLQTGKIQLLDNVTSDYLSRIKSLTNVKLTNKVGTPMRYFGFNMQSNPGKNKKFRQAAAYAINAKTYVAQLNGLGTYNPSLIGPELFGYNKNDKKAATTYNLKKAKELVKANGFNKKTYTILVGNQPAYVQMAQVVQQQLAKAGIKVKIEKQEWATYLTTLASGKFEVTFSGWANSTGDASELFYPNLDSKNIGSSNYMRYSNKQFDAEVEKSRETLNTSERKKALSAANKIAMKDLPWIVMDHNSVAVAQAKDLKGVTVLPTGMWYLGGAYFN

SEQ ID NO: 6120 - protein, 575 aa, Lactobacillus casei
MLEPVLAVQNLNVDFETDQGTKQILHDISLTVHPHETVCLVGESGSGKSVTSFSVMGLLPQNGHVASGSIRFEKQDLLKLGDKAMRRLRGDQMSMIFQEPMTALNPVLRIGKQLTDVIKAHQAVDRKTAFDQALALLKQVEMPEPAKKLQMYPHELSGGQRQRVMIAMAIACKPQLLIADEPTTALDVTIQAQILELINKLKDQEGMGVLFITHDMGVVAQIADYVVVMKQGRIVERGTAQTIFEHPQNAYTKKLLAAVPDVDAPHIAQHSQVTDKQPLLAVQHLTKVYQDKKQLFRKRAAGLKAVNDVSFHIYPGETLGLVGESGSGKSTLGRTILGLEQKTAGKMVYAGKELPPFNHRQAALIAKMQMIFQDPFGSLDPRQKIGDAIEEVMAIHHQMNAQARHQRMLQLLQAVDLDEASANRYPSEFSGGQRQRIGIARALALDPSLVVCDEAVSALDVSIQAQVLDLLKQLQEKLKLTYLFITHDLGVVREISDRILVMYLGTIVETGTTEQIFTNPVHPYTKRLLAAIPRPNPESAVAARQRNERILAEHIPRPTSTELHEVEPLHLVVNF

SEQ ID NO: 6121 - protein, 68 aa, Lactobacillus casei
LAEKAQISAFSREIIDFQRKNHLTDTEMALNSHVSVEHIHNIKSMREMPDSSVVATLKDYMEHKPNGK

SEQ ID NO: 6122 - protein, 101 aa, Lactobacillus casei
MEHYAYLQDLAASQSDRDLRVRIWDNKNIIIRRNQSQHQGLATQVWDAWLRQELRRFNGFEPIIEVDDFSGHQEIKFFKENELADAVHFILQGEGTVETAS

SEQ ID NO: 6123 - protein, 155 aa, Lactobacillus casei
MKAIILYASITGNAKGMARIEQQFFEHYGWDVTLGEMIQTDPSKIKDYDVLVLATYTWTGGVIPEETQDFYEDLSKMDFSAKPLVFGVLGTGDPYYGKDYNTAPELFEAVLRASGAVQGAEPVKIALNVKQEEMPQFAAFTQSLIKKAEALQSEK

SEQ ID NO: 6124 - protein, 80 aa, Lactobacillus casei
MSEEIVFFNPGDAVANDYDFAAARRSAQIYKAQHVVDEGLVVAKDKDGKYSVFYEAAGTPDSKAKGDYKNVGKYTILAHL

SEQ ID NO: 6125 - protein, 64 aa, Lactobacillus casei
MTKNTWYRVALVVIAIVLIAVIYFFMQQHQIANPFVVGGLGLTLGVVLALLLASFWQPHDSQKH

SEQ ID NO: 6126 - protein, 320 aa, Lactobacillus casei
MPQVYVSAALPKSANAALQKAGVDFDAYNGKGLITEEELQSHLANTEVLITALSTPVTAATLAKAPHLKLIANYGAGFNNIDVTAAKAQGVLVTNTPKVSTTSTAEVTLALMLAVLHRVTEGDRLMRGPGFSGWAPTFFLGHELAGKTVGIIGVGQIGQAVAKRVHAFDAKILYTQHHQLTPEAEQALGATFTDRATLLQQSDIVTLHLPLVPATHHLLDAQALATMKSTAYLINAARGPLIDESALLKQLTDHRLAGAALDVYEAEPHVSSGLKALDNVVLTPHIGNATVEARDAMAKIVTDNTLAVLNGKHPQYVVNG

SEQ ID NO: 6127 - protein, 133 aa, Lactobacillus casei
MATLTQDMKDMIGAQLNYLATADENGNPQVGPKGTMRVLDDHHLIYNEETGKQAWHNLQYSKKAAVASVDYKALKGFRFEGTVEFHNDDKIFEDAQAFAKERHLPAAISAVVINVDRIYKLDAGPNAGDLIEG

SEQ ID NO: 6128 - protein, 85 aa, Lactobacillus casei
MMHLIWTLIIGAVIGCIGQLIVGRDMPLGWLGNIIGGLIGAWLGTALLGNWGPSLAGMALIPAIIGAVIVVFLVSLLLGSTRRKA

SEQ ID NO: 6129 - protein, 179 aa, Lactobacillus casei
MKPITKGLFGLVAVCGLLQSVGFGLLLWPNREFTRFYLQQAVWLRPLMIGLTGLVLLVFLIMLLVAIFRRSTANALILAGDDGDLTLDKSAIENTVAKAIVARHFAKSVDVDVSIRKKQVARMRIAAFSGNGKELKQEAKQIEETARQKLQECLGVPVKHVRVQLLPATKVKAKTARVI

SEQ ID NO: 6130 - protein, 65 aa, Lactobacillus casei
MQQGTIGAVIGVILAFAWMRFGFMGMMLVVIFGGLGWLIERYLVPNWGNLMSWLTSGKDAFSKGK

SEQ ID NO: 6131 - protein, 138 aa, Lactobacillus casei
MDAVASPKTAPAPKANQHETLMANSRVTFEDKVIEKIAAICAQNVDGILGMDGSVMDNLTETFSSGENLTKGISAEVGEKQVAIDMDVFLEFDSNAQAIFKQLCGKISAQIERMTGLQLVELNMHVKDVLTKREWQKR

SEQ ID NO: 6132 - protein, 141 aa, Lactobacillus casei
MDNKKQSGINKELKFDDAVIAKIVGITCNEVEGVYSLEGGMMANITDMFSKDEDPTKGVNVDLSDDQDVSVSLDATVRYGENVPEIFNKVTMAIAKNVRQMTGLNVTEVKMTVKDMLTREEIARNEAKDKDKDKDKEMQPA

SEQ ID NO: 6133 - protein, 228 aa, Lactobacillus casei
LEYLKLLGIVIIVVGFALKWDTTAVVVLAAIVTAVFSGMSVPDLLTTLGQSFVDNRMVSLFFLTLPMIGLVESHGLKEVAVTGIQKLKKLTPSRILNLYLVIRELGGVFGISLSGQVQFVRPLITPMVTAAAESKRKLTDKEIDLIKARSAATDNFGNFFAQNLFVATAGVLLIASTMKGLKHPVEPMQVVLASIPVAIITLVVVAIYNRWFDRQFETDPRADKGGKR

SEQ ID NO: 6134 - protein, 304 aa, Lactobacillus casei
MVNTLLLVLYALIGVVMALAGIESFRAKDNPARIGTGLFWLILAVIFAFGTLLPAMVVGILVVVIGVLALFKQIQIGKIKPVDGAHAAQAAKRLGGWVFVPSVVLAVVSIAVAQFTKLGGQVGIGIGAAASLVVAIIMTKASGKMVYNDTQRMVRSVGAAGILPQLLATLGAVFTAAGVGSLTAKLIAGLFPAGSHLGGVILYCVAMALFTIIMGNAFAAFAVITAAIGIPFVIAQGANPAIVAAIGMTSGYCGTLLTPMAANFNSLPVALLEMDDPLGVIKQQAPIAVLLLVIQIGLMYFLAF

SEQ ID NO: 6135 - protein, 215 aa, Lactobacillus casei
MKILVTGFDPFGDDKINPAIEAVKRLPDEINGATIVKLEIPTKFNVSADVVHDAIVKEKPDYVLSIGQAGGRFELTPERVAINLDDGRIKDNAGYQPLNHPIHEDGQTAYFTQLPIKAMAKAIRESGVPASVSNTAGTYVCNHIFYQVQYMRDKEFPTINAGFMHIPFLPEQVVARPETPALSLDDDVKGITAAIKAIVERDGKGDLETVEGKTH

SEQ ID NO: 6136 - protein, 126 aa, Lactobacillus casei
MELDGKEIKENEQLTDAQLTDLHQQYQALWDKLKKDNYRTEHQFMEVLYEEPDNVQNYEAAFFTYQIRKDTGDNQFDQLNIILNNKPTFHDQPEEFVFEISDYPDMDAIYKAIEEKAQPWIKAHKR

SEQ ID NO: 6137 - protein, 224 aa, Lactobacillus casei
MADTIKIAYLYEDLMNTYGDSGDVKILRYLLNQQGYQVQVDNISLGDDFNADDYDFIFFGGGQDYEQTVVAKDLLRYAQTLGRYIENGKPMLAICGGYQLLGDYYKTSEGTVIKGLGILPLHTVFKPDSRMIGDTKYQTEFGTVKAFENHSGRTYFDDKKKLKPLGKMIEGYGNNPEDGVEGMRYKNTIGSYSHGPILKNQNIAKAIAKMIVQNHKDRIGQPAH

SEQ ID NO: 6138 - protein, 238 aa, Lactobacillus casei
  misc_feature (5)..(5): Xaa can be any naturally occurring amino acid
NADPXIDREDCTASECENZYMEFDEPENDENTVSIGIIGSGNVGRALGQLFSHVGEKVILSHRHGVASLAPVIAEMRSTVEAGTVAEAADQDIVVLAVPFNALDELPTKVKADAVVIDATNYFPSRDGERLALTEHHTTSSELVAQHFGTKKVVKAFNTIAMTKIRSLAKPNQSSDRIAIPIAGDDATAKQTVTNLIEKIGFDVVDLGDLADSYPAQADGPLFLFTGDADQVRAQANK

SEQ ID NO: 6139 - protein, 130 aa, Lactobacillus casei
LLNKKAVKKYMYFSVLGIGIWLIKSEPYDMTKIALAINMGYILFFAGSLLSVPSFFLISSFLLIYGNSSFENHFNRRIVQNSIRLFEVTIIIVACLVFVILGSLNNSVWLIPLAFLCINAILVGTSKQQK

SEQ ID NO: 6140 - protein, 239 aa, Lactobacillus casei
MSNAIRLTTLAIVSALVTTPLIESVVPVQAAEVVESTTVQNTPEAGKTIVARTEIQRDFLAMQDEITNQLDVLNGKYVYDFNTIEKIVEKFDFATLNKETGSNFSAKNFLTVAINDINSTRLPRRTKRGRYYNYNGTAEGWNYRRSFYDTWKSKAVAQQLNNAARDFGYFGPGIGGALALAAGPVGAAMGAAFAGSSAFTSWYAGGLASSITYNNTGAGVVVDINKYTQAYSVFDQKKF

SEQ ID NO: 6141 - protein, 473 aa, Lactobacillus casei
MFKHFSKLDSWALVLFLLIVIGGPILILFSISDSFLPFIHHFGFVIFMIVISSSTWVLLLTMYYVFMMLFGWGKARRDYPLVAPKSRFLILIPAHNEAAVITSTLEHLQQLDYPKTAYHIVVVSDQSTDQTTALAAAQGVQVVDTSRHRYQRVGVGKPAGLQYALDELTDSGTLQQYDLVMVLDADNFTDPNLLRELDSQYQVKHFTAIQAYLDSKNDNTLLTLGYAMSYWTMNRFFQLSKYRLGLDNSIGGTGFVVERQWLEANHGFQSHSLTEDLEMEIRIVESGGTVGWNHFARIYDEKPDHLHASMTQRFRWSRGHWYTAFHNLLPLLHHFLKTGDLRDLDQLSYLFSMRQNFQYLLASFFGIAWVISLVMPSLGLHPIWLIDVDRSYFVPITLINWLILLEGFIPMIAGFLYDANWEGSKWLITPKAVLAFFWFSLTYLIVQIGGLLTFPNQKAWAHTQHVLTVTHHL

SEQ ID NO: 6142 - protein, 243 aa, Lactobacillus casei
MDPTAFVHALADHGIVLDDRQQDQFAAYYQYLISENEKMNLTGITAEGDVYLKHFYDSLTLGLVLPELQSQPLSLCDVGAGAGFPSIPLKIAFPQLKITIVDSLQKRIGFLERLTTRLELTDVQLFHDRAETFGAKKSSHRGQFDLVTARAVAALNVLAELCLPLVKPQGRFVAMKAAATAEELIAAKPAIGLLGGKLVQDAALTLPETGDPRHLLVIEKVKATPNKYPRKPGVPNKQPLGGA

SEQ ID NO: 6143 - protein, 275 aa, Lactobacillus casei
VALSFFGHKKPNDETVVQQLPLNAITPNQFQPRKVFSADSIQELAATIKEHGLLQPIIVREYAPDQYEIIAGERRYRAMQLLGWEKAPAIVQKMDDDESASMALVENLQREGLSAIEEGQAYVALMKLNQLTQGALAQQLGKSQAFVANKIRLLKLDAPVQEAIMKGLISERHGRELLKLGDDQQAQALHQIVADKLTVKETSALVNEWLRPKKPEKKPKPKVRRSAVSHDTRVAWNTLKRSVKMIRDTGMTVTAKEEDTDDAYRMIIEIPKEKR

SEQ ID NO: 6144 - protein, 255 aa, Lactobacillus casei
MTHIIAVANQKGGVGKTTTTINLGACLANLGKKVLIVDVDAQGNATSGVGVQKAQVEKDIYDVLVNEDPITEAILPTKHKNLAIVPATIQLAGAEIELTSQMAREMRLKLGLHPIEDQYDYILIDCPPSLGQLSINAFTASDSILIPVQSEYYALEGLSQLLNTVRLVQKHFNPNLAIEGVLLTMYDARTNLGAQVIDEVRKYFGDKVYATVIPRITRLAEAPSYGLPIVDFDPKSRGSEVYEALAKEVLAAHGE

SEQ ID NO: 6145 - protein, 290 aa, Lactobacillus casei
MANKNSKGLGRGIDAIFKDFESPDLSANNTVEELPLVDIRPNPYQPRKTFDQEGLKELADSIKQTGVFQPIIVRKSVSGYEIITGERRFRASKLAGKETIPAIVRDFNDPEMMEIAVLENLQREDLTPLDEAQAYETLIKRLNLTQAEVSARLGKSRPYIANYLRLLTLPQQVKQMLSANQLSMGQARTLLSLKDKTKMVSVAKKTISENLTVRQLERLINQMNAGTGRSTSKEKPKSPYVRATENQLGERFGTKVNINEGSKGKGKIEIDFTSEQDLNRILAMLDVNID

SEQ ID NO: 6146 - protein, 63 aa, Lactobacillus casei
MYQLHDLVQMKKPHACGTNKWEVIRLGADIKIRCTGCGHIVMMSRRDFEKRLKKVLGQAEQAD

SEQ ID NO: 6147 - protein, 340 aa, Lactobacillus casei
MANYPFATIDPNVGMVEVPDKRLARIDELIPAKKIIHTTFEFTDIAGIVKGASKGEGLGNKFLENIRQVDAIVHVVRAFDDDNITSVTGKVDPLEDMATINMELAIADLDSVNKRYAKVEKVARTQTKDKEAQAEFKVLQKIKPVLEDGGMVRSIDFDKDEQKIVKGLFLLTSKPVLYVANIAEEAMADPDSVDYVKQIKAEAAKEGAEVIAISAKTEEEIAELDDDEKADFLAAEGVDESGLDKLIKASYHLLGLATFFTAGGKETRAWTFKRGMKAPQVAGIIHSDFERGFIRAETMSFTDLDKYGSVQAVKEAGRYRSEGKEYQVQDGDIIEFRFNV

SEQ ID NO: 6148 - protein, 264 aa, Lactobacillus casei
MAKKQETDTNQTADSAAVDQQQTAASSAADAQQSAATVASKNAHVKQERPATTVPEMIARLTNKNNEYVFKLRRELKDGGMSEADEETLLKTMLPEMITAQRQGKPATQLYGPVTVKANEILHTPKPEPKKPLWLLVADQGLFFMAILAAVFAVMTYINPKSQNNASNSFAYLVMLSLMAGLFFVYYADWMERDKKNRRSAWLVLGGGIVLVLAVTFIGGALMMLDTPFTRAMPWFVDVIIAVVAYGSHWLLQRRYHLKSFFRR

SEQ ID NO: 6149 - protein, 370 aa, Lactobacillus casei
MNKGHQQQYGRGFVLAAVALAGFGLVNAQPTQAATSANGSASQAVEQASAVKSVAAKDQTLVFALLNGIAANYHQAITVQIVAADNGQVVATKTLASTDEYEPSASISGLKIGAADGLQAGHTYRLQVVASGNQGWKAVPDSFVYTPGQTTKIEMDKYTYQKGERAFQLVDQQTKQPLANVKVAAIPNLVDGAKSAIVKTTDAQGRVTFSTDDPQFKRNVFYHFELPDKHVTVGYNWNLIGGEKADDKAAVVSVKMPAVASSSSQASQASSQASQKPSQAPSQKPSQKPSIDPSAQSSQPSLRASSSASASQKASVESVAAQTSQAASSAESGSTHGLPKTGEALGQSGLLAGLATLLSALGAWLWRRQG

SEQ ID NO: 6150 - protein, 495 aa, Lactobacillus casei
MSHWDTKFARRGFTFDDVLLIPAESHVLPHDVDLSVQLADNLKLNIPIISAGMDTVTESAMAIAMARQGGLGVIHKNMSIAAQADEVLKVKRSENGVIVDPFYLTADKPVSDAEALMKKYRISGVPIVNNTTDRKLTGIITNRDLRYVDDKSVLIDTVMTKEGLVTAPAGTSIKDAEAILQARKIEKLPLIDKNGRLSGLITIKDIEKVVEFPHAAKDAHGRLLVAAAVGVTSDTFDRAQALLDAGADAIVIDTAHGHSAGVIRKIKEIREHFPLATLIAGNVATAEATEALYDAGVDVVKVGIGPGSICTTRIVAGVGVPQLTAVYDAASVARKRGKTIIADGGIKYSGDIVKALAAGGNAVMLGSLLAGTDEAPGQFEIYQGRRFKTYRGMGSLGAMAQAHGSSDRYFQSGVNEANKLVPEGIEGRVAYKGSLGDVIFQMLGGIESGMGYVGAPNLKELQDNAQFIQITGAGLRESHPHDVQITREAPNYSVQ

SEQ ID NO: 6151 - protein, 229 aa, Lactobacillus casei
LEKLTNVVAASLPQDMRIAGINIAHTSGSTYWLLYQQSDWLTLRLATHVHWLNGVQQLQVIWPDMPDVAGLKPVLTHALLSPAAHQAAFEFTPTDIAIANMLLWAANRKLVFMLRLTPAMASAHKHRQFDLHQDLEPLPLFLGDRNNSNDLLLPVADQRLKQHLIRFYSRNLLFTQFSGHHLIKLLPTAQWLQTMLTIMPPTRAWPLTVATTFGTQVLEVFHQARLRHR

SEQ ID NO: 6152 - protein, 228 aa, Lactobacillus casei
MKILIVDDDKEIVELLSIYVKNEGYEPIQAYSGKEAITKLVTNPDIALMILDIMMPNMSGMDVVKEVRKDSQIPIIIVSAKTADMDKIQGLITGADDYVTKPFNPLEVMARVKSLLRRSQNEVTNPEPDVLEVGPLTIKKDSHEVTTLTGKQIQLTALEFGILYLLASHPNRVFSADEIFERVWQQESIVSAKTVMVHVSHLRDKIEEATDGEKVIETVWGVGYKVEA

SEQ ID NO: 6153 - protein, 396 aa, Lactobacillus casei
MSEKVKLTAKEKSELWIEGIVTVILLLMLNFALLVLINQMIAHNPGLENAIWGVKTNLTFGRGGFHLWSWSNLFLTMMAIADVIVVYWRLARRYRQMQMRHVIAELHYIADGHLDHRIKFEVNTELQKVVSSINALVDSTVNSMAEERRIEQSKDELITNVSHDIRTPLTSIIGYLGLIEDHQYRSEEELLKYTHTAYLKAKQMKVLVEDLFEYTKVKSTTTKLNPVRFNMIAMLEQLAASFELEAHKKHMRILVSGEPNPLMMEADTEKLGRVFNNLIVNALKYGQGGRHIFLDAQRVGSEVVVKVSNDGAQIPNDALNQLFDRFYRVEESRSQETGGTGLGLAIAQSIIALHGGYIYADSSPELTSFVIHLPLKVGASLTDKPKHSNEEAGKSK

SEQ ID NO: 6154 - protein, 436 aa, Lactobacillus casei
MKKLLRGLIAAMAAVLMIGGAAPAVSVAAAESSDTNVVDAKAAVAIEPTTGKVLYAKNADSVLPIASMTKMLSIELVLDAIDSGKIKWDDKVTLDKTIWSLSQDRDLSNVPLRRDGSYSVRELYDASLIYSANAAMMLLAKTVAGSQEKFVNQMTAKLKSWGITDAKIVNVTGLNNSQLKDAKVPGTGDQAENEMSAKDMAQVAQHLLKDHPEVLKTTSIAKQTFRKGTDDAINMENWDWMLKGLVSYDKNLPVDGLKTGTSDAAGDCFTGTVKKNGMRIITVVLHANGDAKTRRFDQTKKLMNHVLENWKTVQLADAGQSIKGYRSVTVNRGKSRTTPIASAARAVAVVPSDTSKQDLKYTYTPAKGVKKNTIEAPVKKGATIGHLEVTAKGDSLGFVGGAKREGITLKTTKADPKANFFVLIFRGIGDFFGNIF

SEQ ID NO: 6155 - protein, 159 aa, Lactobacillus casei
MVTYHEITPAGLASLKQEVEDLKAIRPAKIKNLAEAAALGDRSENAEYSAAKRELRQLEGRLRYLDKLIRYAKVTAPAASDIADIGNMVKLKFDDDDDQATYELVGPAEAGMGADKLAVNSPLGAAIRRHHAGDTVTVTAPSGTYQVTILAIQTGKANA

SEQ ID NO: 6156 - protein, 517 aa, Lactobacillus casei
MALSLRACILLLKEHHLLKSAAIQTTEDVDMTGIAYDSRKVSGPTLFFCKGDKFRPIYLSMAKDNGAKTYVAEKPYVEGNGLNALIVRNITKAMAILSAAFFDYPQDDLFVIAYTGTKGKTTASYFTEAILNEARPRHIALFSTIDTVVGPEPNQRFKSNLTTPESLDLFRDMREAVENGMTHLVMEVSSQAYLRNRVFGLTYDVGFFLNITPDHIGPNEHPTFANYLHNKLQLLVNARKVVINAETEHFDQVYAAATTTTYPESIYLFASAGFKPKRDDIDIDFRFDSQEADVAESRFTLVPVTEKAAALNIGGHYSLALIGDFNESNATAAIIGAGLAGVDASAAVPGIAKVKIPGRMEHVQIAGHGTVYVDYAHNYASMKALLSFLKRSYKDPRMLVVVGSPGDKGVSRRPGFAKVLTELATEAYLTTDDPGYEDPANIVNEIDSKIDHSKVKVHKVLDRKEAITEAIKASGPQDVVVVAGKGADPYQKIRGVNTPWPTDMAVVKEVGKSLQEG

SEQ ID NO: 6157 - protein, 249 aa, Lactobacillus casei
MRQFFTVIGGMGTPATESYVRLLNQRTHAHSDQEYLNYILVNDATVPDRTDYILDHSKPSFYPDLLEDIQAQSLLNPEFIVIVCNTAHYFYDQLAAATPIPLLHMPRLAIRDMCERFPNEKRVGLIATQGTIKDGIYSQEIENTGREVVLGDQALQDMVTELIYKYVKEKGEVNAELYHRILKRMHDDFHVNVIVLGCTELSFAQEKAGDHPYHVIDAQSIIVDKTLALGKAFRKSEADGKALLNQLMV

SEQ ID NO: 6158 - protein, 286 aa, Lactobacillus casei
LAHLTKLTDTYTLNNGVEIPIVGFGTWQTPDGEVAKHSVETALAAGYRHIDTAAAYGNEDSVGAGIKASGVPRDQIFLTTKLWNADHGYEATKAAIDRSLQKLGVDYVDLYLIHWPNPIQFRNNWEEANAGSWKAMEEAYQAGKLRAIGVSNFRAKHLDALLKTANVKPMVNQIFLNPSDLQPEVVDYNKAHDILSEAYSPLGTGKIFKVEALKKIAERYNKSVAQVVLRWSLQHGFLPLPKSVHDERIKENAQLFDFELSHHDMTLIDALHGEAGLATDPDTTDF

SEQ ID NO: 6159 - protein, 39 aa, Lactobacillus casei
MQSALYDCAKPSRETAGVFVCRDEIYEGETACCFLALMS

SEQ ID NO: 6160 - protein, 267 aa, Lactobacillus casei
MLRKERIDAMQAYISDVKTASMKELEDKFDIAPSTLRRDLASLIAAGTVKKVYGGVTDNTTTPSTKGNALTVYSERQLAAPTEKHQIGRAAAQLIEPEDLIFIDSGTTTAEMGGFLPTDFPFTLVTNNLQIINQAAPLANIKLVIIGMNFDRRTQSFTGIDDMNIFSRFNIGKAFMAATGISLTRGLSNSEYNEYLIKAEIFKKAHRKILLIDQSKFGRVSLLTYGALQDIDAIVTYGDVDAKYRDFLTENNVQLINAKKQQAVSPS

SEQ ID NO: 6161 - protein, 495 aa, Lactobacillus casei
MRKAGIVNDKGEAALAPQTSGGIKSEKLPKSARRRLRIISVIATFGGMLFGYDTGVINGALPFMTKAGELNMSPSMEGLVASSLTLGAAFGAVLTGRISDRKGRHKVITALAMLFVVSTIASALSPTAPILASVRFVLGLAVGGASVIVPTFLAEVAPSNLRGRIVTQNEFMIVSGQLLAFVFNAILGTTLGHIPGIWRWMLVLATIPAIILWIGMNFVPESPRWLAANGKLDQALSVLREIRTEEQARDEMEKIQISLKSAQEVKSASIADLKIGWIRRLVLIGIGLGIMQQIVGINVMMYYGTTILQTTGFGQNAALIANILNGVTSVVATIVTMHLMSKFKRRQMLLTGISGTLFSLVGITLTSHFLAGSPMLPYFTILLTIIYLAFFQGALGPLTWLLLSEIYPARIRGLGMGFATFFLWISNFFVGYFFPVMLAGIGMSNTFLVFVGANIISLIFAWRFAPETAGRSLEEIELDNKFDDKFPEKSKINKN

SEQ ID NO: 6162 - protein, 491 aa, Lactobacillus casei
MTTQQAVKTLKNFINGKWVDAKTDTFEDVYNPATGEVLARVPHSSSEDVADAVAAASAAFKTWQRVSIPKRAKILFKYQQLLVEHQEELGRIVTEENGKSLSEAVAEVGRGIENVEFAAGVPTLMMGDSLTTVATDVEATNYRYPVGVVGGITPFNFPMMVPCWMFPMAVATGNTFVLKPSEKTPLTSQRLVELFQEAGLPDGVLNIVNGSVDVVNGLLDHPDVKAISFVGSERVGEYVYKRGSEHLKRVQALTGAKNHTIVLEDADLDAAVKGIISSSFGSAGERCMATSVLVLQESIADKFMAKFTQAAKDIKIGNGLDKGVFLGPVIRKENQERTLNYIKTGVKEGAKLVLDGSEEAKERDGYFVGPTIFEDVKTDMTIWHDEMFAPVLSVMRAKDLPEAVAIANSSELANGACLFTDSAASIRYFRENIDAGMLGINLGVPAPIAVFPFSGWKHSFFGTLHANGKDSVDFYTHKKVVTARYDQSRFK

SEQ ID NO: 6163 - protein, 271 aa, Lactobacillus casei
MSLLYQKQNQEIRPGVHLIQDVNASNSPMKYTAVKVLALDANASYDETLGDFEAGIVVLAGKVTVTADQQRFEGIGQRQSVFDKIPTDSVYVGTGLPFGITAQTAAKILIAYSPTTTSFPVRLLKGDIHQIEHRGKYQNKRLVQNILPDDLPFADKLLLVEVYTDSGNWSSYPPHRHDHDNLPTESLLEEIYYHEMQPKQGFVFQRVYTDDHSLDETMTVQNQDVVIVPKGYHPVGVPDGYDSYYLNIMAGPTRVWHFHNAPEHAWIIDRK

SEQ ID NO: 6164 - protein, 324 aa, Lactobacillus casei
MSKKFDLIAIGRAAVDLNAVEYNRPLEETKTFAKFVGGSPANIAIGSAKLGQKVGFIGKVSDDQLGHYVTQYMAEVGIDTSQMVKDDAGHKIGLTFTEIISPEESDILMYRNEAADLYLAADEVSKDYLDQAQMLVISGTGLAQSPSREAILKALLLAKELGVEVIFELDYRPYTWQNAEETSLYYQLVAQKADVIIGTRDEFDVLENHQGNTDEQTIATLFQYDANLIVIKSGVQGSNAYTKAGDKYHFGVFKTKVLKSFGAGDSFAAGFLYAYSHHLGIETALKYGSAAASIVISQLSSSEAMPNLAQLTEFIQKAETQGVH

SEQ ID NO: 6165 - protein, 653 aa, Lactobacillus casei
MSAMELEPQTKASQRSAPDTVRLTTAQALVRFLNQQYIDVDGEVTPFVEGIFAIFGHGNVLGLGEALQEDPGHLKVYQGHNEQGMASTAIAYSRQLYRHKIFAVTASAGPGSANFVTAAGNAYVNNIPILFLPADTFATRQPDPVLQQIEVDGSATTTTNDTLKPVSKYWDRVERPEQLMSALLKAFEVLTNPATAGPVTVALPQDTEGEAFDYPLSFFKKRVHVVKRIQPSAAELAEATRMIKASSYPVLIVGGGAKFSEAGPAIEAFSNKLKIPIVETPTGKSTVSSAFANNMGGTGVLGTAAANDVIAKADLIIGAGTRYTDFTTASKTAIDPEKTHISNINLNRMQSYKFDGFPVVADVRDTITQLTNALSGYESGFTDLADTKAAWQKERNRLAHTNYDAPDFTPEVKNQFSPETLAEYAAKLKTHFTQTEAVIAVNDTIDPDSIMVAAAGSLPGDVQRIWDPVEPNTYHMEYGYSMMGYEVPAALGVKLAEPDKESYALVGDGSFIMLHSELVTALQYHKKINILVFDNSGFASINNLQMAQGSNSYLTEFRTADHDILTIDFAKIAEGYGAKTYHANDRESLIAALEDAKKQTVSTLIDIKVLPKTMTQGYGQSWWRVGVSEVSDNPKVQKAYRAIQEGIDQAFKY

SEQ ID NO: 6166 - protein, 346 aa, Lactobacillus casei
MVVKVGVIGTGAMGRAHIDRLTNVLTGAKVVAVTDINQEAAKAAVRDFKLDAKVYLDDTSLLQDPDIDAVFVVSFGGAHEATVLKALDTDKFIFTEKPLATTLEGAKRIVDKEMGKPRKVIQVGFMRRYDEGIHALKAQLDSGIIGTPLVVRASHINPDVAANYSNEMAITDTLIHEIDEMHWLLDDDYASIQITYPRQSSKVNNEGLRDPQLATLTTKKGVVIQVLVHVTAQYGYEVKLEVVGETGELKLPDYGFAPIVRTQATQQTAMETSWVKRFLQAYNTEVQEFINQVAKNQSPIGPSAWDGYIAAVTAEAGIRSQKDQEPVLINVAATPAFYQKKQAVKA

SEQ ID NO: 6167 - protein, 350 aa, Lactobacillus casei
MAQRTVKIGIVGLGRLGKIHATNLATSIQHAKLQAATSVVPEELAWAREELGVEETYEDFDDMVQNADIDAVFIVSPSGFHLPQIESAMNAGKHVFSEKPIGLDLAAIKHTQAVINQHPDLKFQLGFMRRFDDSYVYAKQLVDEGKIGDITLIRSYSIDPASGMESFVKFATSANSGGLFLDMSIHDIDVIRWFTGKEIDKVWAIGLNRAYPVLDQAGELETGAALMQLEDKTMAILVAGRNAAHGYHVETEVIGTKGMLRVAQVPEKNLVTVMNEEGIIRPTSQNFPERFAQAFLSEEKAFVDSILQDTSVGITAEDGLQGTKAALALQQAFEKNDIVKVDDVDKKVGA

SEQ ID NO: 6168 - protein, 298 aa, Lactobacillus casei
LTIELGIAPIGWTNDDMPELGKEVTFEQAIDEMALAGYQGTEVGNKYPKDPAVLKHYLALRHLKIASAWFSAFLTTKPYEETEAAFIKHRDFLHAMGAKVIVVAEQGHSVQGMLDKAVFDDKPHFTDEEWQRLATGLERLGDRAHEVGMQIVYHHHMGTGVQTTAEIDKLMAMTDPDKVSLLFDTGHLVLSGEDPLDIFNRYKDRIKHIHFKDVRPEQAKQERAEHMSFLAGVKNGMFTVPGDGMIDFKPIWQAIQKSNYSGWIVVEAEQDPAKANPLEYALKAKQYLDTIMAIPQAV

SEQ ID NO: 6169 - protein, 290 aa, Lactobacillus casei
MALIPATTLMQAALAHHAAIGHFNINGPDWLETYLSVAEETKTPIIVATSDRIMDFLGGFDFMSRYVRFMIQALEITVPVVLHLDHGLSVEHVYQAIDAGYTSVMFDGSKLPIAENVALTKKVVAYAHQRHVSVEAEVGSVGGNENGLISGVQYASVADAVKMAGTGIDSLAAALGSVHGDYVGRPKLNFERMTEIAQATQLPLVLHGASGIPDDQIQQAIQTGTAKININTEVNTVWTEAVAKALQQKHSGHDPQPILTAGKQAMARLVESKMNDFHILGKSARLTAME

SEQ ID NO: 6170 - protein, 129 aa, Lactobacillus casei
MPLVRFDMLKGRSPETIQQILQITHEVMVAAFDVPARDRYQIVHQHEPYEMVVEDTGLGIPRTDKVVVISLVSRVRTVHQLKQFYATLAERLSAAGLVDKNDLMINVSFNNDQGWSFGQGKAQFLDGSL

SEQ ID NO: 6171 - protein, 292 aa, Lactobacillus casei
MTIQIEKIALNRKVAQNRSLESFFQLATEVGIHQVELRNDMTASDRPETVIDQMPVADFNALKAKYGMKILTINALQQFNQPAKLVANRQLLTGLAELAVQIGSPAIIFVPEVNPQDNRTPQQRLEDAAHNLQVFGEILATYHLTGLVEPLGFMASTLRYPWTAQQAIKLSGRTEFKLTIDTFHFFLAHITAAQFKANVDVKRIGLIHLSGIEPIHELREVLDEDRMFITDRDIMQNVEQVQLFEAMGYQGNYSFEAFSTRLAAESNQQLAHEITTSIAQLNQPTAVSGLEV

SEQ ID NO: 6172 - protein, 287 aa, Lactobacillus casei
MKLAYDPSMFRDTMTLKQMFDEVARLGYEYVELSPRRDFIWFYEHPVADTALIKQVKRYAQDAGVKISSVLPVQQWSSPDEQEREFAVRNLKRTIEITAALGVKVLNTEFSGDKFQPLVSQGQWYKSMEELAPEFEKNGITLEIQPHPNDFIESNLAASRLIRSLDVDWVHQVWCSSHAFYMDDGRGDIRQQFAESGDLITHVLIADTFNHKGNQGLRYIINPPGAPVTIHQHLNPGEGEVDFATLYAVLRERHFNGIITNNVFAWPDKVDWSNKITLQSIKNGLQL

SEQ ID NO: 6173 - protein, 280 aa, Lactobacillus casei
MHDFLVQLQIYKPNLSRQEKKLADFLQTHPDRASQANIAELSAITGVSTATISRFAKALGYPNFQALRMALVQSPPEPDQKLFAELSPDDSVETLAQKIFTSNIDALRTTLANLDTAALTKAINWITHADHLGLFGLGASNLVALDGYHKFLRTAIPVSYAADYHMQLMAATHLGANDAMILTSHSGEDKDAIALADLAKQQQVPLIVITGAPASRLAKMADAAFVAVAEESRYRTEALHALIAELSLMDTLFMISAIQTNSQTAPLFRRVRATIDATRR

SEQ ID NO: 6174 - protein, 305 aa, Lactobacillus casei
MQVGMVGLGKMGMNLVANMRDHDIEVVAFDLNDQARTEVGQYQARAVASLDALVMSLASPRIIWSMVPAGKPTDATINQLAKLLRPGDIVIDGGNSYYQDSIKRSQLLAKDGIHFFDVGTSGGMAGARANGNFMIGGDQTQFAKIEPLFKAIAAPGGYLYTGPAGSGHYLKMVHNGIEYGMMQAIGEGFDVLAHSPYDYDNEAVAKMWNNGSVIRSWLMELAGNAFSDDADLEKIQGIMHSSGEGAWTVEEALRLHVATPVIASALMMRYRSEAADTMTGKVVAALRNQFGGHAVDPTTGKQGGK

SEQ ID NO: 6175 - protein, 522 aa, Lactobacillus casei
MSIKYMIGVDLGTTSTKVVLFDLKGQAIATANNPYPLYQDTPDMAEEDPEEIFAATVGGLTEVMHRGNVQPGELGGVSFSAAMHSLILMDEHDKPITRVITWADNRAAAYATKLKQSDLGMTLFKATGVPTHPMSPLVKLLWLSAEHPELVARTRHFIGIKDYILFRFFGRYVQDYSLANATGLFNIHTMDWDDRALDVANVRRDQLPELVDTSYQLTGLNANYAAVTGIDDKTPFILGASDGTLSNLGVGAIDPGVLAVTIGTSGAVRVVTDKPVVDPQGRLFTYYLAPNKWVVGGPVNNGGIVFRWVRDQLFAPEKITAEQLQVDSYEVLTDIASKIPAGADGLLFHPYLGGERAPIWDANARGSFFGLTRQHTRAHMVRAALEGIVYNLYMVMLMIEGITGKPRAIQATGGFARSALWRQMLADVFEQEVNIPESFESSALGAVVIGMKSLGLIDDLSVVKDMIGVTNTHEPNEANFQAYRELLPIWIRLTRKLGSEYQAIADYQRAHPDPRARSKEQD

SEQ ID NO: 6176 - protein, 450 aa, Lactobacillus casei
MDLLVLVLGILLLLVLIIKFKFNTYVSLIITAVVVALGLGMAPAKIATSIQTGIGSQLGELALVFGFGAMLGRLVADAGGAYRIAHTLINAFGRRGLQLAVVLASFIIGIALFFEVGIVLLVPIVFAIAAEAGVPILTLGIPMAAALSVTHGFLPPHPAPTAISTALGASAGLVLAYGVIIAVPTVYIAGPLFSKLAHRLVPDAFERRGNLKALGPQKTFKLDETPGFGISVLTSLFPVILMAIATVYELVLHGGKTPKTPTGMDNLIVFIGSPSIAMLISLLFAMWAMGYARKLPAKDIMATLEDAVKSIAMLLLVIGGGGAFKQVLIDGGVGDSVKNLFVSSSISPLILGWLIAVVLRIALGSATVAAMTASGLVLPLMQSAGIQPALMVLAIGAGSLAASHVNDAGFWMFREYFDLTIKQTLLTWTLLETIISVVGLGGVLLLSLFV

SEQ ID NO: 6177 - protein, 114 aa, Lactobacillus casei
MYEPTKKRRVAEDVAKVFPEEVTNQLFDVIAVMQKAKQLVTAPVAIAFSDDYTDDEMYAMIIQGNLAPAQEFPLTYKGDKPFLGHGYILVVKDKPKTIRIDFSAANPFKADKTK

SEQ ID NO: 6178 - protein, 239 aa, Lactobacillus casei
MSEPILSVKHLSFGFRDQQLYRDLSFHLDVGSITSLVGPNGVGKTTLIRLLMAQLKPQAGTIQFRKQPPVRLGYVPQFRNVDEEFPLSIRSFIQLRQLDHLFFWHTPKEKAALNRVIKATHLTHIADTRLGMASGGEKQKAYLAQALLDDPNFLILDESTASLDVNTKHELMDLVQELNETQKLTVLFVTHDLSLAKQYTKQYLLLTGDRYEMKPTAEMDLASMPEELRNDAENRGVIA

SEQ ID NO: 6179 - protein, 265 aa, Lactobacillus casei
MNLFAYAFMQNAFMASTFIAITTGIVGVFVVARNMSFLAHTLSEVGFAGAAFAVFAGIRPLDGMLMFTAISSISVGRMSVQASRREASISAVSSLFIGLGILFLSLSSANASYATTILFGSIIGISRSDVWQLVALAAGVLFTLYFGYRRLAFDSFDPVGSAAQGLKSKYISIYFLLILAVSVSIGAQIVGSLLVFILLTLPPNVAKYLGRTLPQMIVISVITALIGVWSGLYLGFLTNWPVTFFIAAIEFIFYFLALWYHHQTN

SEQ ID NO: 6180 - protein, 282 aa, Lactobacillus casei
MTKIAILSDIHGNMTAFSAVIKDAQAHHPDEYWFLGDLFLPGPGAANLWHDLHALPLTHLVKGNWDDDLFWVLDGPVDLAQPTDVYFSRLVAYLWPQLTADMLTTIRHWPLHDVFEQDGLVISLAHNLPDSNHGHRLYPDQPQANFDQIAPSQDIDIAIYGHTHQQLLRYTSSGQVILNPGSIGQAYSPRAKLQTTSYADYALLELSNGAITNLNLRQVSYDVSAELAVAKEAQLPYLEVYTKLRHTGATSTHDAAYLAQFDQSHHYRAEVAEFLRQQRERH

SEQ ID NO: 6181 - protein, 293 aa, Lactobacillus casei
MSPLKLGFIGTGVMGTGIIKNFLKAGQEVIVYNRTKTHAQAVLDAGAVWAESPHAVAAQCHVVMSMVGFPQDVEAVYFGCDGILAGTQAGDLVIDMTTSTPTLAKQIAEKAKEKGVIAIDAPVSGGDIGAKKGTLTIMIGGQKDLLPKLKELFAPIASSVNYFGPAGSGQHAKMANQIMIAGTMTGLSEMLVYGKAAGLDLNEILKVVGSGAAANWSLSNYGPRMLQADYTPGFFAKHFLKDLRIALDEAKKMHLQLPATELAEDLYAKMVAAGKGDLGTQGLVTMNERWDEA

SEQ ID NO: 6182 - protein, 599 aa, Lactobacillus casei
MQHLPVREDVPTKLTWDLTTIYPNDAAWTADFEAVREQAKEAAALKGTLGNSAAALITGIKAVLAVFRRFEKVYVYSSLKSDQDTGNATYQAMNAKAESLGAGLASQLAFLDPEILAIPADKLAAWRDTESLKPFGHFIDAITVNRQHVLTTASEALIASAGDALNASHATFNVLDNSDLQFGFVENEDGETVQLSNGLYGQLIRSTQRKLRKEAFETLLRAYESMKNTFAQTLSGQVKAHNFNAKAHHYANARAAAMASNHIPESVYTTLIDQVNTHLPLLHRYVALRKKVLGVDQLHMYDIYTPLTGKPPLTFTLDQAKAEALKALAPLGDDYLSHVREIFDNRYIDVVENKGKRSGAYSGGSYDTNPFILLNWHDAVDELYTLIHETGHSVHSWYTRHNQPYVYGDYPIFVAEIASTTNENLLTDYFLTHTDDPKVRAYILNYYLDGFKGTVFRQTQFAEFEHWIHQQDQQGEPLTATSMATYYADLNARYYGPDVARDPEIAFEWARIPHFYYNYYVYQYATGFAAASTLAAGISSGEPNAASRYLDYLKSGSSQYAIDTMKTAGVDMTKPDYLEAAFSMFEKRLTELEELLQKG

SEQ ID NO: 6183 - protein, 364 aa, Lactobacillus casei
MSKQQDSNLRTTHDKPKRRHPILRAVVVIALVALFLAGGYAARFYSQAKKAVAKTYDPVSTKAVDSDLDGKKPISILLMGTDTGAFGRKDTGRSDTLMLVTINPKEKKTTMVSIPRDTLAEMVGTGNDSSTYEKINAAYSYGKSSAAIKTVEKLLNVPINYYVTVNMEGLQKIVDAVGGVDVNVPFTWTDANTGGQTFKKGKAHLNGELALAYARMRDEDPEGDYGRQKRQQEVINQIVKHLLSVKSLTNYQKVMDSLSSSMRTNLTFDDMMAIAQNYRASAGTIERKQLRGIGVYIDNAAYQVMKTDTLQKTSDELREQLGLQSEKLSNFNTRQNEINNAAGFDWTANNPVYTVSLDGATTGP

SEQ ID NO: 6184 - protein, 488 aa, Lactobacillus casei
MGNAPHARLNKLLAVSVAIAIVYKMEGFSMSTQPKLTKRQYLTLGSLLFGMFFGAGNLIFPIHMGQLAGSAWLPAAIGFLLSAVLLPLLSIMAISLTRASSMYDLARPAGHGFALFFLLATHASLGLLIASPRTATVTYAIGISPFLGKGQQQIGLLIFSFIFFLTTFLLARNESKITTYIGKLLNPLFLILLAFIFFWALLIKGDIRTISFTGNANLISGNLVNGFLQGYNTMDALAGLGFGVTIITALKLMGLHRASSRAKAVAKVGSLAMGLEAVIYLLLIMLGAISLGFAKLTANGGTAFNQIMTHYTGLIGTALLGAMTLLACLTTAIGLVTSFSQDLGHRFPKLGYHFFLPITTIGAFFIANFGLDQIIAYSTPILMLLYPLAIALIMLGLLHPWIGKNTRIYKTTIAFTMIPALLDAIHALPAGLAQLPFFAAIQHFASTFIPLFGIGMDFVPFLLIGFICGFIAAKFSGAKLAPDLPDPD

SEQ ID NO: 6185 - protein, 227 aa, Lactobacillus casei
MASNHSQKVEAIADHATSDSDNSKVSAKSIVLSNEAKVEQANAYSLINPKNENTITVGTNDIAEAAHQIADQKAAAAKAAEEQAAAEKAAAEKAAADQAAAEKAAQEQQAQAQASQAAANAAAASAASTSTAQTTQTTTNKGTFKLSFYDPAVLGSNMGYDGVAANLSVFPKGTRLKITLSDGTVWYRTVNDTGSFAAGNPNQLDVAMPNSQIPSAGVMSATVEVVG

SEQ ID NO: 6186 - protein, 252 aa, Lactobacillus casei
VAMYREKRFEEIKRLLAVRNELSIDDIMKAVGVSRDTARRDIVALDAQGIARRTRGGLVSLNFGHSIPSYSARLKRFSTQKTKMAKAALSLIKPGGVYFIDDSTTLLKLSQSIRHPVTVYTHSLDNAIALSVEEQVNLHLFGGKLDHHARFFFEPTMLETLRRIAFDAAFIGATAIAEDGVYFSYMEDAQVKQAAALSARQVVVVSETEKFQIEAPYRGLELGQISTLITDKKLSAPQKRWFAPQTNFIVGS

SEQ ID NO: 6187 - protein, 260 aa, Lactobacillus casei
MTTPLVTIIVPVYNLEAYVAHGLQSLLAQTYSHLQIIVIDDASDDRSPQIVSHFAQLDNRIHAILKSVNQGVSAARNSGLAQARGELIAFMDGDDWYEPDFIAHAVKMMNQGWDLIAMPFFRDDPDPKPVRSGLRKAKQLTREGLIRQMLHPVGYIRGYLWNKVFRRDVIERMQLRFDEQMSIMEDELFTATYVMATHHFLYTGHPAYHHVVRRDSATQSLGVFGAIPQQLYALWRIHRVLRHARRRAKANKKETVKIDH

SEQ ID NO: 6188 - protein, 253 aa, Lactobacillus casei
LAENLMTFPQLKQAAKKQLKTGTNRRDLMLAYLLPSLLQAAATITVYLMIQAVVQGFGAEKVLTDPTGFQAYYAQSSNDSGMVNTIQSLVVTMLAQGVNFAVLDLVRNHERVRPLQAVLGLFNGKWFWGSISLWIFMCFLTLIGFSFLIFPGIMLALGWRQAFWVFKDGHEADQRFSSITALIGSWRLMKGFKSDLLGLYLSMIGWYLLENATFHLFDWAINPYLQLVHANYYENRRAYKMAALHRNGSDVHF

SEQ ID NO: 6189 - protein, 110 aa, Lactobacillus casei
METEAYMTLAEVKKRQASLKDKMPLDQAIAENIQNWAQWLLDEGFEGSYFTAKLNGNAIMISDLDGRQVATITTDASSYVDAFKQSDRMTMLTVQSKLRRLIDQHGIKTQ

SEQ ID NO: 6190 - protein, 118 aa, Lactobacillus casei
MAREVYDCADGCPVQSTVQFISGKWKSVILYHLLRGDATRFSTLNRAIPSVTERMLALQLAQLEADHLIVKKIGTVSDNRSMEYSLTSFGRSLTPVIEAMAAWGSAFNDHKIEASDNV

SEQ ID NO: 6191 - protein, 156 aa, Lactobacillus casei
VKAIFLFDEHHEHLWDLTAERLRSEVPSDEAYQATLKKLNSFKAAFGTILFFEDSATVRQEEKDYPLYRDNFQDWAEQAQGGAQQAVWVALALNNIGASLQHYNPLIDEQVREAFAVPAEWVLRAEMPFGSIEAPAGEKSYLPREKRFVVFQHKAV

SEQ ID NO: 6192 - protein, 153 aa, Lactobacillus casei
LTRKSTQLTLTFKPVAAPLFGQSADSKPDTLTIYIEPSEGYSLQLNGKALGTGLTIEPDELRYRHDPKAAAAAPEAYERLINNVLEGDQTNFTHWSELSASWHLIDAIQAAWSQEPNMPTYPAATMGPEAAFDLLSRDGREWFWQPHRVQMAD

SEQ ID NO: 6193 - protein, 199 aa, Lactobacillus casei
LKNNNQSALRTILEFLLLFVVIFFASQLLMRYVLSKDVVQGTSMQPTLENNERLYSVRIKKPKRNDIVVINAPDRPKSLYIKRVIGMPGDTVSSKNDKLYVNGKAIAEPYLNHKFSRDEINKWASQQGLDPSSIKFTNDFNIKTLSSTKSAKVPAGKYFVMGDNRLVSHDSRDFGFVDKSKIQSVVVWRYWPLNRMKIF

SEQ ID NO: 6194 - protein, 311 aa, Lactobacillus casei
MGIMESRLIHATVGFAIGDALGLPVKGQTQAELAASPVTGMKGYGTFNQPAGTYSDETGLTLAGLDALQHGFDQDALVNAYQAWFKNGEYAPYGKRNPDIWPSIETTLTTGKATAAPNEPGALIRTLPFAFFAYQTFDTKLFEKAEGSRLFQNFVTLTNLDPENMIAAAVYTQIAIELLADAPDLPTAITTGINKTGAYFADQPTYQPAFAAFNTQFEAQTPDGTATDPLSLLARTLHALQTWPDYHDAVLNALMLGGATDTAAALTGGLAGLAYGYTSLPHRWCLMLAEYAQIVDLCRQAEKSGFFPKYD

SEQ ID NO: 6195 - protein, 515 aa, Lactobacillus casei
MSVLTVTGLSQRFLDKVLYQDASFQVNIEDHLGVIGQNGVGKSTLIKILTGALTPDAGKIVWQKHLHVGYLDQYANLVPGQTVIEFLRTAFEELYRKEAKMNEIYADYATNPDDALLTKAGELQQELEAGDFYELETTIQTVAEGLGITAMGMDHPVDALSGGQRSKLILAKLLLEKPDMLLLDEPTNYLDVSHIEWLTDWLQNFEGAFIVISHDFDFLENVTNAVLDIEFGQITKYTGTLKQAMRQKEADHETYLKAFAKQQETIKKTEAFIRKFKAGTRATMAKSREKQLARMDKLTPPGTRSKAHLAFPYLPVNRQILVDVNNLVVGYDQPLLQPINFSVAKDQIIAFEGFNGVGKSTLLKTILGLIPAISGSVEIADNVVFGYYEQELHWDQPKQSPVQYLQQRFPALTQKVVRQVLSRTALTSEEANNPLTMLSGGEQAKVKLAELMLQTTNILIVDEPTNHLDDDTKNALRTGLQQYPGAVLLVSHEAGFYDRSWVDTVVNVEQLQVKA

SEQ ID NO: 6196 - protein, 248 aa, Lactobacillus casei
MKEDRAFWNQFAEDYAAAEKASRLPIARDVTAWLLAEGLLPTKSLVDLAAGTGHYAARFAAHVQQLTLIDWSSAMLAYARQQLTANSTTSVNFITADWHQLETLPAADLIFVSQLPTLEANELSLLTDWANQSVVLNFQSEQSDALMDRALTYLGQTVPVAYQADPSRVASYERWLRAHHIPFKSHTLTYHLEEQTTISDLLPELTVPLGVKAASQLSKALTGNENAHMPVTDHLTYTYTQLVWHSDH

SEQ ID NO: 6197 - protein, 106 aa, Lactobacillus casei
MPVNATKETLKELTATGTVVVDFWAPWCGPCKVVDPILSALEKELSGLKVVRYNVEADASVPQTLRIMTVPTIVVYQQGQPKEKVSGVYAKEKLKRYFEKKLEAAR

SEQ ID NO: 6198 - protein, 258 aa, Lactobacillus casei
MTHLVEQAQMQTPNRVLATCLLAGRIMIEGGSEMYRVEDTMRRIAFNAGQPQTLVFTTPTGIFASIENQPYIQERPISKRSIDMEKVSRVNQLSRSFADKEIDLDALYAALLKLDQNTPFFPIWWQVIGAAVVSLTLMVLFAQKYNWFDMPLAALVGALGFWVNIKVNALTNIRFISELLGALVVGLTAWIGVKLGLGHDLDDIIIGAIMPLVPGVAITNSIRDMLAGHLLSGMARGMEAILSACAIGVGIAIIFRFF

SEQ ID NO: 6199 - protein, 152 aa, Lactobacillus casei
LPWFVALLIQLSFSYLATVAFAVIINVPRKALNLAGWAGMMGWLAYWLLMEAGIGRMMANLTGAFVIGVCGIFFARYKKMPVIIFNIPGFVPLVPGAVAYQAVRAVVMGQLDSALQYVSRVIMIAGAIAVGFMLAQLLSELLYKQAVLKPKK

SEQ ID NO: 6200 - protein, 397 aa, Lactobacillus casei
MKKSVVKALIGAGVVAMSMLALTGCATKSAANKGNTAGTTIKIGVNMELSGAVAGYGEQEKQGVELAVKQINAAGGVKVGNSKKKLTAVYRDNKSSTSGAASVAAQLANNEKVVAIVGPATTNNGTASIPNITKAAVPMVGPSATDPNFTLQKNGQVQPYVFRACFTDTFQGQKAAVFADDTLKAKNVAIIADNSTDYGTGLAKAFRKKFTGKVVTTEYYQSGDKDFNAMLTNIKNKKIDAIYAPGYYSELGLLIKQARQSGIKVPIIGADGMADPKLAQIAGNENATDVYYTTPFSTLAANRSSLVKTFMNNYQKQYNASAPTFSALAYDSVYMIKQAIEDQKSADSASIAKGLAKIKNMPGVTGTTSIDSKHNPEKPIAVEELTQGKITKAYTVK

SEQ ID NO: 6201 - protein, 292 aa, Lactobacillus casei
LQTMMQQMINGLSLGSIYALLALGYTMVYGIIKLINFAHGDIYMLGAFWGYYAINFLHLGFVGALLSAMVMASLSGVLIEYLAYRPLRNSPRIAALITAIGVSFFLENGMSFLFGANARNFPQVITTKTYYVFGVGISNVQLLILSTSLLLMVLLQFIIKQTTMGKAMRAVAVDPQAAQLVGINPDHVISFTFALGSALAGAAGVMIGLYYNSIDPLMGMVPGIKAFVAAVVGGIGSVPGAAVGGFLIGLLETGVQAIGLSAYKDAAVYLVLILVLVVLPAGLFGKRQREKV

SEQ ID NO: 6202 - protein, 317 aa, Lactobacillus casei
MLKNLRSKLIWLAIMVSGFVLINVGELTGVINTFIENALVTVGINIILAVGLNLIIGFSGQFSLGHAGFMAIGAYATAIVTQNMATPLGFYLAMALGMVIAIVAALIVGIPTLRLRGDYLAIATMGAAEIIRVVINNLKITNGPAGMFNIPPLASWPTVYILMCVTTVVIVNFIHSRAGRAVMAIRDDDIAAESIGINPTKWKLAAFVLGAATAAIGGSLHASYLQTIAPGDFGIMNSISLLIIVVLGGVGSMTGTFVAAIVLGIIDTALQNFGTLRMVIYALALILLMVFKPSGLLGHYELSFGRKRRARKEAASS

SEQ ID NO: 6203 - protein, 261 aa, Lactobacillus casei
MTNQLVIDHVSKVFGGLKAVADVSLTIEQGALIALIGPNGAGKTTLFNMLTGESGPTTGKITLTTANGDVDITKKKAYQVAKLGVARTFQNIRLFGAMSVKENVLVARTHLYHEDFLGTVLRLPQFYQREHDVGAAADELLDFFDLADVADEPTASLPYGTQRRVEIVRAVATKPQLLFLDEPAAGMNPEETADLSRLIARVREHFGITVVLIEHDMSLVMNLAEYIYVLDHGAMIAEGTPQVIQRDPQVIRAYLGGDVHA

SEQ ID NO: 6204 - protein, 238 aa, Lactobacillus casei
MLEVKDLVVNYGGIQAVKDVSFRVHTGEIVALIGANGAGKSTILKTISGLLRPRSGTILYEDKNIVGMAAAKIVKMGISQVPEGRHIFAGLTVSENLQMGAFGLKDKQAASDQLAVVYDRFPVLRERLNQDAATLSGGEQQMLAMGRALMARPKLLLLDEPSMGLSPIFIQEIFDIITKINEQGTTVLLIEQNAKQALAIANRGYVLASGTVKLTGTGAELLADPAVQATYLGAQPAT

SEQ ID NO: 6205 - protein, 107 aa, Lactobacillus casei
LTLTEHQQWLVHFYQKHNWYAYSPFIRLNFLTEETGELSRAIRALEIGRDHPGEPVKSQHALDANLKEELADVLDQVLILSDKFGIDPESLLEQSERKLTQRFKRHA

SEQ ID NO: 6206 - protein, 279 aa, Lactobacillus casei
VFPATKWMAQNVKSARVVHNSRMQPIILIPGSSATEDRFNTLITQLNNQTNGHSLLKITVKTDGTLTYSGKIAARDTEPYIVVAFENNKDGYNNIKKQAAWFNIAFKQLAKTYNFNRFRGIGHSNGGLIFTLFLEKYYNESDVQMTRLMTIGTPYNLEESNPNNRTQMLNDFITSRDKLPSTLTVYSIAGTENLDGDGTVPIESVEAGKYIFQNQVAHYTQITVSGDEAGHSDLPQNRQIVNLISQYMVATPNQQGVRPGQGGSGRGVGPAPRDGSQNP

SEQ ID NO: 6207 - protein, 438 aa, Lactobacillus casei
MSNLMQRLLPMLVANSVRLRHNRIYRALQQTFAVIFPFVMVGAWAQMLELSVFSRNGFFAVIYNLDNVIPHYNQIRTLLLIIETVTVDLMSVMAAFFVAKYIARSYKKDDSLAALTSVGAFLILNFNAQRNAQSPFQMNNFGYRGLFIAIVFGLLIGWLFRFTHADFEEPSQHYTIAGLISRGLRGTWLTVLILISCVAITYGLTFVSTEGFIGLFYVVFQVPATNIPHVSLRLALVTTINALMWWGGIEGPINPLMVQSGSTTGTANLNYALEHANLFNVPNPITMNTIYHPFASFGGVGMTLALIIATLWVGRSKPLRRIAGLSLLPGLVNVSSPVMIGWPVTLNPILLVPFLITPLVNMVIAWAAIRLRLMPPSVYTVPTTTPGPLAAFLGTNGNLVALVVAVICLIVSVLIYAPFVRLAETVSLESAKVGDHHD

SEQ ID NO: 6208 - protein, 224 aa, Lactobacillus casei
MNKNEKPLAKYIDHTLLKPDATQDEIDVVLDQAKQYDFASVCINPYWVARAAASLHDTDVNVCTVIGFPLGANTTQTKVFEAGQALDEGAKEVDMVLNIGELKAGHDDHVRADIQAVADMTHAKGGLLKVIIEAVLLTDEEKVTACKLAAAAGADFVKTSTGFAAGGATVHDVALMRQTVGDKLGVKAAGGIHSYAEAKALIEAGADRLGASAGVQILKEAGEA

SEQ ID NO: 6209 - protein, 396 aa, Lactobacillus casei
MAFERVITIVLDSIGIGEAPDAAKFHDTGADTLGHIGDYFGGKLALPNLQAIGLGNIDRRTPIAGVGPLGSPSGYFGKMAEISAGKDSMDGHWEMMGLPVTEPLGYFPKGFPADLIKQIEDFSGRKVILNKPYSGTEAIKDYGEQQLKTGDLIVYTSGDSVLQIAAQTDVIPLEELYRICRYVRSITIDAPYRIGRVIARPYVGTDPTTFTRTSDRHDYTLQPDKPTDLDRLQGAGVPTYGIGKINDIFSGQGLDDGVHTVSNTDGMDKTIEAAKSDRKGFIFTNLVDFDAMYGHRRNAQGDGEALMTFDRQLGDLLTALQRDDLLMITADHGNDPTFRGTDHTREYVPLLAYSKQFVGNGDLGVRSPFADLGATILDNFGVSGNQVGQSFLSLLK

SEQ ID NO: 6210 - protein, 238 aa, Lactobacillus casei
MSTHIAAPKGAIADMVLLPGDPLRAQYIAENFLENATRYNTVRNAFGFTGTFEGRRVSVQATGMGIPSISIYVNELIQDYGVKTLIRVGTAGGMGKDVKVRDVVLAQGSSTDSSIILNTFGAGMYFAPLADFQLLREAANLADDSSIRYHVGNVLGEDRFYNDEMDRQKLIDYEVLATEMETPALYLLAAKFHAQALSILTVSNHLITGEETTAQERQTSFNDMIGLALGVAKKVPVR

SEQ ID NO: 6211 - protein, 473 aa, Lactobacillus casei
MVKSKKVWSVTAGFVGAAGLAALATGANTVSASTTGTVNYKTGATTVWNSPSWNHVKRYVTFGDTVQLLGKTVDHNGATWYKVGDNQWIPELYLNVDGKTAQVEAPASTASQAPASQAPASQAPASQAPASQAAPAATPAATQSANIQLYVKNVGSAVTVWATPAYGRATGQYLEGQQSVTAVAQQQANGETWYQLSNGGYVPARFVSTTPVAAAPQSTAPQSTASSAAAQPAQSAASQAPASSSAAQPSQAPASQAPASSAASSEASQAPVSQAPASSSAAESQAPAASQAPASSSAAPESTASTTTTPVASSSTAPQTEQLSATQSTNNNNNTNTATVSATQTQTSTDTSRQAKVQAVIAVAEQQIGKPYIWGGKGPTGFDCSGLMYYAFLHGAGVNIGGWTVPQESSGTQVSLDALQPGDLLFWGNHGSTTHVALYIGGGTMIQAPQPGENVKYTALAYFQPDFAVRPDL

SEQ ID NO: 6212 - protein, 611 aa, Lactobacillus casei
EIICBCMPNENTMQVIVKRLEKHQALFEKISRNIYLMAIKDGFLAAMPIILFSSIFILLSNIPPLIGIKIPTDLNAWFNKIYNYTMGFVGFYVAGTTAKALTGSMNQRIKGGRFINNTSTMMAAMVGFMLLAIGTTGKGNFLPTFFGTQGILSAFVAAFVTVWVYKFCVERDLTIKMPKEVPGAISQNFRDIIPFGAATIVFSLIDVAARAAFKVPFSAILATVLAPVFKGAETYPGMMLIWFLIPMFWFLGVHGPSVVKPALESALFGNTTANLALFKAGHFPYHALTENFGNFVGELGGTGATFIVPFLFMFFMKSKQLKAIGKASFIPVMFAVNEPLLFGAPIILNPYFLVPFVLAPVVNVVIGKAFIDLHIMHGFMYFMSWALPGPIGALIDTGFQWTSLVLMAILLVVDALIYMPFIRAYDAELLQEEAAVDAADAGAVATATAAGAGEVAAEADAATAQEFPEPADVKAAKAENASTDDGQTAKGPRKLDHELKVLVLCAGGGTSEQLANALTDGAKTYHEPIVASAGAYGSHHDILPNYDMVVLAPQVRTYYSDLKHDTDRLGIKLVATKGQQYIALTRDPEKALDFVVNHYKESDTKETPATE

SEQ ID NO: 6213 - protein, 289 aa, Lactobacillus casei
MLLRVKQVYNNNAVLVDVGNGKEAILQGRGIGFSKRKDDQIDPKKSSEILYLNDAQVKNHFTSLLKDVPIDIVVATFGVIGMAKKTYHYPVLNYIYVTLTDHVFQMYKRLTAGKYQASPAPDIRDRYPLAYQIATEAVKRLNHDLGVHFPDAEVKNIALHFINAKGVDGDLDPTVTLTARVNTIVTQVFAKYGLKRSLTNQNYFDRLMIHLQYLVERLNTDEQDEADLDPKIGQDFKRLYPKSFAIAMEICTELEKALQIKLNENEHVYFIIHIQRLIQEPQTPAPQDS

SEQ ID NO: 6214 - protein, 121 aa, Lactobacillus casei
MATKEEISMTGFAIVAYAGDAKTDLIEALNEARKGNFKHARSLVEEARQSINEAHNEQTKLLSKEAGGDNMDVTFIMVHGQDTLMTTMMLLDTISFTIDEYERLAAIEKQLGIALPTNDIH

SEQ ID NO: 6215 - protein, 474 aa, Lactobacillus casei
VTSLLKRVQSLPKGFVWGGATAAYQVEGATKVDGKGKTMWDDYLKAQGRFSPDPASDFYHLYPEDIELAKLYGLNAIRVSIAWTRIFPKGYGEPNPAGVAYYHRLFKCCLDNGITPYVSLHHFDSPKTLFDDGDWLNRKNIDYFVDYADFCFKEFSEVKNWFTINELISLAFSQYIQGNFPPNHHFDVTSGIQAQHNELLAHARAVNLFKEKGYQGRIGLIHVLQPVYPYPDTPANEHAAALEDAFMNRFLLDGTFKGEYTPETMALINELLEANDAKLKIEPGDMDILKKASTQNDYFGMNYYQPSFVAAYEGESTNSFNGTGEKGTSSFKFQGVGQHVKKPDVPTTDWDWNIYPAGMYDMLKRVAMEYPNSKTIYITENGLGYKDKYEGIGQLIDDEKRIDFIDQHVEALLKARSEGVDVQGYFVWSLQDQFSWANGYNKRYGLFYVNFETQAREIKKSALWFKELGQTLKD

SEQ ID NO: 6216 - protein, 464 aa, Lactobacillus casei
  misc_feature (5)..(5): Xaa can be any naturally occurring amino acid
NADHXIDASEMKIIVIGATHAGTFATQQILTDHPDANVTVYERNNNLSFLSCGIALWVGDHVSDPNKMFYSSPEALAKLGANMQMEHDVLSVDPDAKTVEVKDLNTGEITTDTYDKLVYTTGSTPIVPNIPGIHDTDVHLCKNWQDAKTLKDLAPTIKSAIVIGAGYIGAELAEQYAVTDKQVTLIDGLPRVLAKNFDATITDRVEKLYTDHGVHLALGEMVTSFAKNDQGETVVTTDKGTYTADIAILCTGFRPNTDLLKDHLDTMPNGAIITDAYMQTSDPAIFAAGDTAAVHYNPTGKHDYIPLATNAVRQGILVGKNIVAPTEKYLGTQASSAVELFDHAIAASGLTTEGAKARGLKLDSVTIEQDYRPDFMLTTTPVLCSLTWDPQTHEVKGGAFFSKHDISQSANVISLAIQTHMTIETLAMVDMLFQPNFDQPINWVNAVAMAAVEKANAADKEPVA

SEQ ID NO: 6217 - protein, 278 aa, Lactobacillus casei
MNYFPIIRGKLYDLAAITTLANSQRLPATVIPVLEPVKDIPGLTKTTQALTKTAHAAYVIQNPQVGSYRLLATPRHLPMLSPSVQVARIFDAQPAPLIIATTAAQAKLLARRQLALVPDEARVRRLGLRHAVYLNDHFTVYSHTSAYGLLQDEFYQYSLDMLPGVGFADYPLATSDYFEHGFPQRALAIHLVYPATDGSLRLHHFVSVNNEDFTNPQAKFFEILTQLAAWLPYHPQAQTAGVTALMKAAADHHFPGLGVVRKFQLMHHLEMIGRWLQD

SEQ ID NO: 6218 - protein, 226 aa, Lactobacillus casei
MKTQLTRDLEKTLYAYWEEQGATAVEEVTMPDDFGIVDTLVRQKQENETIWRCFELKVTKADFHSQARLSFVGHYNYFVLPQRLYQAVVAEIPAGIGVFVYHPFSKAAIAASAVPVSTPGTLTIAKPARRQSLQVAEEQLTDHFIASLNREVVKAKQVAKGLGQFSTAELFTELRKRTADYDIYHPDKNLYDQFVDDLNNTTITALQEEVDALNAEVATLKMDRLS

SEQ ID NO: 6219 - protein, 795 aa, Lactobacillus casei
MAHNRIGIREFVELTVRTGDLNPITSNSNNTAIIGSQIHRKLQAAHHEPDYEKEVYLKTTVTVEDEDYQLEGRADGIWTDDNKTLTVEEIKTSARPWEECTQNTKDRYWAQARIYGHLLCQQRHLDHATITLVYVQTSTDTVTRFTETKTAAELADDFTDLLTEFTDWLKLRSDIIKRRNESIDALDFPFPEYRAGQHEFAAAVYKAIYSSARLFVQAPTGTGKTISTLFPTVKAMGSGLIQRAFYLTAKQSTRRVAEQAMALMAGSGLKAKSITLTAKDTITFADEPDDPSQNPYMLGYYDRLKSALHDLLAHEDQITRSVIETYARKHTVDPFEFSLDASLFCDVIICDYNYLFDPLVFLQRFFSDADDSQFFLVDEAHNLVSRARDMYTASITDQDFANLKKALSPYKGAALTKLRRAITRIVNTLSAITDQRLMKQSPVFEEAPLDDLTNALAKFTETVHDWLAEPPTPALQPAVDLVLPVFFLANQYLRIGDFYDETFKTEITKDHGVVTVKELCLDPSHFVDESLKKGRGAVLFSATLSPMPYFQKLLGGVDNSLTYALPSPFDPQNQAVIVDTSVNTTYRRREQDLPQLIASLTTLVSAKKGHYLFFFPSYAYLKIAYAAFTAANPALKTCVQENAMTEADRQAFLDHFKADHEPVIGFAVLGGIFAEGIDLRGTQLIGVAIVSVGLPGLNAETDQLRDYFDQNSGQGFAYAYQLPGFNNVLQAGGRVIRGAKDVGVILLIDERFVTPRYARLFPDHWTHAQVSRNPAQLAQLLTHFWEAHHEDPAHA

SEQ ID NO: 6220 - protein, 429 aa, Lactobacillus casei
MKKTSFWRLLGFLGAILVLLTACGKQSSAAKSSSSSAPVKITYWHRMTGSYDKALNKLITKFNQSQKKYKVVATSQGSYNALQQKIMAAGKSKTLPTMAQSPYTNIGDYVKNQLLLPFDSEMLNGSDKLSSSQLKDIYPSFLAAGKYKGKYYGLPFSVSTSVLFYNKRLMSQYNISMPKTWADFAADQDKLKGTDINAVELDQSYDVPLEGMAYGAGSQLITPKLKANLNAPKTLAAVNQILDLRKSGALKTAGEDQYFSVPFANGKAVFGIGSSATVPVLLQQAPKNLEWGTAVIPEYEGKRSNPLNGNYNVLFKGASKAQQAGAWAFQKFLLKSENASQWAMDSGYVPVTKSASNSTTFKNYLKKHEQYKAAVSAVPQSFASTVFAGYTDYRNDLMSTVDSTLTKNVSGETAFDQLQKQTEKILKEN

SEQ ID NO: 6221 - protein, 63 aa, Lactobacillus casei
MKSHKKACLIYSISWAIMFVSALIWFTSKDGLTIDTLINSLGIATLGIIFLVYGWFVLTYERK

SEQ ID NO: 6222 - protein, 216 aa, Lactobacillus casei
MEINVHKFQEAVLAGTFEHTEVHLTAAAFKKDGVDAAMEKVFADVRSAIEKNQLIQADLVIDFPEPTTITVETGVINLPFANVNKITNFLEPDEIVPVRVYLIVTSPFVNVSGLRIDEAATAADYLQDFATINDQMIASVQEKLDHIQTEMAKPKEIAKEVPANKQKPTAKKTTRRTATKKRTTTRKTTKKTATASKAAAKTTTAKKTTTRKTAKK

SEQ ID NO: 6223 - protein, 575 aa, Lactobacillus casei
LKKQGIHVWLLALAVLLGIAVGLKQPPKQVAAADNRLQSVFSIDAGRKYFSVDQLETIIDRAHTDGYTDVQILLGNDALRFMLDDMSLTVDGKTYASDAVKQAVLAGNQTYYNDPNGNALTQADMNAVLKYAAARDINIIPLINSPGHMDAILTAMTKLGIKNPAFNGSKRTVDLNNDTAIAFTKALLQKYVSYFKDHATIFNFGSNEYANDVDTGGWAKLQQTGTYRKFVAYVNDLAQMAENSGLKPMVFNDGIYYNDRTDFGTFDQNLIVSYWTAGWFGYDVAKPEFLANKGLKIMNTNDGWYWVLGRMTGNLYSYETAVASLKSKKFTDVPGASSTVPIIGSVQAVWADNPSAQLDMPALLKLMDQFSTTYTAYMPRPADYSKVDAAIATVPRQLSQYTDASLAKLEAALNAVIRGKKANEQAIVDGYAQAITAAVKGLQLRGADYSQVDAATATAKKLDRQHYQDFAAVDAAIAAVKRGLDITQQNKVDAMANAIQAAIKGLALKPTPPKVPTPSTPEPAPKPTAAAPAKETNKQPPLPGTAEATTPALMLAGASLLASMGLLYWRRRMTD

SEQ ID NO: 6224 - protein, 46 aa, Lactobacillus casei
MNHNFWKQCATAVQKLRFHKCKSKRLQQLTGGLDFLIGKGERQFER

SEQ ID NO: 6225 - protein, 659 aa, Lactobacillus casei
ABCHPERNREGLATRLKDKKLLILDFLLKHGTVHYDQIAEATGLSERTVGNYLNRLDADLSPYAVKLVRKRNVGVSLDGPADQKAHLLRSIHGQEGFTSQTAREHYLMIKLLLTNRPYTLSKLADDLFVSRRTIDNDFKSVKRVFRENHVTVQTSRTGIQVTASESRRRHMLAKLLRGYWGESLSVAKQKDGEVVQQIQLPAYLNHLVNPATTKAVMQSLAEFLKQSDLIFSDYALQSLAIHLIIACERPKKAAPAPVHPAPLLPETKQLLTLVTKHVHRTLDNADAQQINAHIAAILDRQVSDAPAASIEEQAAPVLRQQIAGWLTGISPDTRLLEDLSVHLSGALARISRGMTIPNPYTEEIKRNFPMAFDAAAQLSMAVAKHYHVTFNDDESGFLALHFESFFERQHAADRISTVVVCSSGVGTSRLLAQRLEERFREKLVITRTIGLADLMRQTIPETLIISTVPIQGMRQPVVIVNPLLLQHDIEKVAQQADRLRFGTDGDAFLSLLDPKLVLPNLPQTDQHAAMQAMIRQLTKNGVFEDETLPLKLAEDREKLATTAMRLVAIPHISPEMVQRPAIALGLAPEGIDWSGQKVKVVFFLALNAAAPSDQRRIYQVMNRMIDDRLFCEKLAQSPTPASALRILSEYVHKGANEFE

SEQ ID NO: 6226 - protein, 151 aa, Lactobacillus casei
LNEVNVTTDVHTDVAVPADKHAALGTIATILSTNRPISADELRDNLIAREDESSTGFGNGVAIPHAKVNGLTEPFVGVVTFKQPVAWDSLDGQPVSIAIVLVMPDQNGADRLHLKMLSKLARKLMDDDFIKALKDAQHDGSQMTKVLDQVL

SEQ ID NO: 6227 - protein, 494 aa, Lactobacillus casei
EIIBCACMPNENTMASFVGVTKCPVGIAHTYMAAEKLQKTGQADGYKVKVETQGASGTEDNLTADEIKAADFVVLAIDVAIDGMERFVGKRVVFSTTAEAIKDPQKLVDEGKHADVYTGEKQHTAENEADAESEDTAHEQSPVIKQLLNGVSHMIPFVVIGGLFIALSIALGGHATAKGMVVAPNTIWSTMNQIGTIGFSLMIPILAGFIAYAIAGRAALAPAMVGAMVSNTPAILGTKAGTGFLGAILVGYAAGYLTKWMNSWPIPKSLRAVMPIFVIPLLGTAIISAAFVYLLGSPISWLMTALQNLLTFLSKSPSTSVVLGLVLGAMVSIDMGGPINKVAFLFGVASITAGTPEIMGAVACAIAVPPLSSGIATLFKSELTSDEEKTAGVSAILMGLIGITEGAIPLATAHPKQVFPGIIIGSGVASAVGMVFHITDAVPHGGPIVGVLGATNNLGLFFLSILIGVIVSTAIIVFLKQRAVAHQKSMASAE

SEQ ID NO: 6228 - protein, 323 aa, Lactobacillus casei
LTEPLFLKPYFNPKIWGGRKLKTEYGFDIPDGKIGEAWIISGHPHGPATIENGPLKGKTLREAWHEDPAYFGPQHSQEFPLLVKILDAEASLSVQVHPDDAYAAAHEAKGELGKTECWYILQADPGSYLIYGHHAKTREQLKDMIEAGDWEHLLRKYPVKTGDFVYVPSGTIHALNKGIVALETQQSSDTTYRLYDYDRTDDQGHKRELHIKQSLDVTTVPFQDPKLDITKQQVPGGQITTFVKPPLSPHFAVYRLDIDGTMPFTQQAPYTNVTVLEGEGTFTADGQDYPIKTGDSFLIPNQIKAWQFTGKLAIVTSTPGVDA

SEQ ID NO: 6229 - protein, 238 aa, Lactobacillus casei
MEKVPLTKQLVDQLETFIKEKLQPNDKLPSERDLSELYHVSRNTVRSALDELFLRGFIYRSTGKGTFVAERFDERTDVSGSYSFTKQMLAMNRQPVTKIQRLEKIAVPANIAKRMRIDPGTPVYVLDRLRIADKLPMMIERSYLPALTVPDLEKDALEKSPLYDWLEEHYGIHIASVDEAFFAGLVSPEDAKLLRVAPASACLNIRRTTFADTGEIVEYTLSVARADQFVYHVHHVNH

SEQ ID NO: 6230 - protein, 393 aa, Lactobacillus casei
LFEKTTEELTKLGAQITTAEIKQQPELWQEAFDNYTRDKEKITAFLKQVTDAANGKQVRVIFTGAGSSQYVGDTVTPYLRAHGDRSKFVFESIGSTDIVSAPYDFLEADTPTILVSFARSGNSPESLKTVELAEQVVHNLYQISITCAPEGQLAKKSASEGKTLLLLQPAGSNDKGFAMTGSFSCMTLSALLVFDTASDADKQQWVKAIATMGQEVVDREAEVQNVINRDFERIVYLGSGSLGGLTRETRLKVLELTAGQYATMFDTSMGFRHGPKSFVNDKTLLFDFVSNNAYTRQYDIDVLEEVKGDKIAPSVMAVGTKQDQNFSGDGFYFENGLKDLPEGYQALPDVMFAQTLALLASIKVGNLPDTPSPTGTVNRVVKGVILHDYSGQE

SEQ ID NO: 6231 - protein, 386 aa, Lactobacillus casei
MSYYIHAAKFFLKHATEIGGYLEITDDGEFGEYLPENAKPDGDIVEQPGKLIAPGLVDTHIHGLLGHDVMDNSWDGIETMSQNLVKAGVTSWLPTTLTGSFDQLNDVCKTIAAHAGEETGAKIQGIYFEGPYFTAKHKGAQNPKYFKNPSEKEYDAWQTSANGLLKKIAIAPERDGAVAFTRYATADGTVVALGHSDATFEQAKACVDAGATVFTHTFNGMSPLNHREPGMVGAAMYLQGVDDELICDGHHVRPEVATTLIRLKGAEHIALITDCMRAGMMPDGDYVLGEFPVYVKDGMARLKDGDSLAGSVLELKDALTNLLTWNAATPEAIIRMATQTPAVSCNIDGQCGSILPGRAADYLVLDTDLTLQATYLDGKMVYQAEA

SEQ ID NO: 6232 - protein, 593 aa, Lactobacillus casei
MTTFSIEHDFMLDGKPFKILSGAIHYFRVHPDDWYHSLYNLKALGFNTVETYVPWNLHEYREGEFDFSGILDIEHFLDVAEDLGLYAIVRPSPYICAEWEFGGFPAWLLTKSMRLRTDDPNYLQAIDRYYAALMPHLVNHQVTHGGNVLMMQVENEYGSYGEDHDYLAALAELMKKHGVDVPLFTSDGPWSATLNAGSMINDGILATGNFGSAADKNFDRLAAFHQAHGQDWPLMCMEFWDGWFNRWGEPIIRRDPDETAEDLRAVIERGSVNLYMFHGGTNFGFMNGTSARKDHDLPQVTSYDYDAPLNEQGNPTPKYFAIQKMLHEVLPDIQQAEPLVKPIMAPAEHPLTAKVSLFAVLDQLAKPVAAAYPQTQEFLGQYTGYTLYRAQPLISGTDKGTPAKLRVIDARDRVQAYLDRHWLATQYQEAIGDDILLPQVEGHHQLDLLVEDMSRVNYGAKIEAITQFKGIRTGVMVDLHFIKGYQQYPLDLNQAPELDFSKDWQPETPAFYKYTFDLTEPHDTYLDCRGFGKGVMLVNGVNVGRFWEKGPTLSLYVPAGLLHAGQNEVIVFETEGRYAESLKMADHPIFVEP

SEQ ID NO: 6233 - protein, 160 aa, Lactobacillus casei
MAIIAARIDGRLVHGQVANLWTTKLGATRIIVVDEAASKSDIDKSGLRMATPETVRLSVLDVKTAANHILNHKYDSQRVFIVAKRPETFLALVEAGVPIKELNVGNMSQTDQTRSITKSINVVDDDVETFKKLDAAGVHLIAQMVPGDPAADFMTLLKKG

SEQ ID NO: 6234 - protein, 303 aa, Lactobacillus casei
MIAWWQIALLTLYAGYQILDELQIYSAMSSPVFAGLVSGLVMGDMKAGLMIGASVQLMVLGVGTFGGASKIDANSGTILATAFSVSSGMKPAAAVAAIAVPVASIMIQTDILARFANTFFAHRIDKMVDEYNYKGIERYFLAGALPWALSRMIPVGLALSFGGGFVTNVAHVLNTSWKWLGDGLTTAGAVLPAVGFAILLHYLPVKKHFAYLFLGFTFTMLFTTLFGSVQMLGTAMTEVTKKFTANFNGLSMLAMAFIAFAFAAIAYQQSTALHDSTGGGSGESGSAPKKNTNEEGEITDDEL

SEQ ID NO: 6235 - protein, 273 aa, Lactobacillus casei
MMNSNKPTYKLTDKDFRQINRRSLFGFQLGWNYERMQASGYLYTILPQLRKIYGDGTPELKKMMKTHTQFFNTSNFFNTIITGIDLSVEEKEGIAGEETVVGMKTGLMGSFASIGDSIFAALIPAIFGAIAANMAQEGNPVGVFIWIAAQVAIMVFRWKQLRIAYNEGVSLVTTMSHRLAALTNAATIMGVFMVGALVATMINVKFAFAPKIGNVPLDFQKYSDMIIPKLLPALIVGAIYWLLGRKHMTSTRAIFIVLFVSIALSALGVIAKG

SEQ ID NO: 6236 - protein, 138 aa, Lactobacillus casei
EIIABCMPNENTMSKLVLISHGQLCEELKKSAEMIMGPQDDIATVALLPNEGPEDFQAKFKAAIEGADDVTVLADLKGGTPNNVAARVLAEGGNFDLYAGMNLPMVISYLNAQMLDMKPDLLGDGKAGVVYINDIVKH

SEQ ID NO: 6237 - protein, 312 aa, Lactobacillus casei
MILTVTLNPSIDVAYPLEHLAIDTVNRVKNVRKTAGGKGLNVSRVIHQLHHDILATGFIGGYFGQWLQHQLDTEGIQHEFLSIHAETRSSIAILHDQGNQTEILEAGPFITKPDAEKFLMHFDQLLTQADLVTISGSLPQGLPETYYTLLIAHAQHQNVPVLLDTSGATLRHALEAPLKPKLIKPNDEELGGLLRHHVDKTDFNALKQDLQEPIFSDVEWVVVSLGARGAFAKHGDKFYHAVIPKINVVNPVGFGDATLAGLAISIHDNQSDEAILKTAMTTGMLNTMQAKTGFVDPTQFQPYFDQVTIEPY

SEQ ID NO: 6238 - protein, 267 aa, Lactobacillus casei
MATDWLNIDGRVFVVTGGSSGIGDAIVKDLLSNHAKVINADLKEGSFKDDNLLFVQTDVTKRDQVEHMVKVAKEKFGQIDGLVNNAGINIPRILTDPTDPDGKYVIDEANFDKMFTINVKSVWLCSSIIVKELVKQHKGVIVNMSSESGLEGSQGAGIYSGTKGAINGFTRAWAKELGQYNVRMIGVAPGVLEATGLRTLSYEEGLAYSRHETVEQLRAGYAKTSTIPLGRSGKLSEVADLVTYFLSDRSSYMTGQTVNVSGGKSRG

SEQ ID NO: 6239 - protein, 449 aa, Lactobacillus casei
MQVIQYIVDLGPSVMIPIIIFILGISLRQGIGKSLRAGISIGIGFVGINLVISLLTDNLGKAAEAMAKNFNLGLSVVDIGWPGTSPMAWASAMGLIAIPVAIAVNVVMLLTRMTKVVNVDIWNIWHMAFTGAIVQLATGSFTWGIVAICIHAAIAYKLGDIFKPVTDNFFGLEGISIPHGTSAYMGIFAKPIDDLIEAIPGLNKITITSKTVEERFGVLGQPSIIGAILGVIIGLLAKFPIGKSLQLGIQMAAVMVLMPVVVKFIMEGLIPISQGAKVIMDKHFKGGSFTIGMDPALLLGNSDVIAAGLLFVPITLLIAVLVPGNRVLPFGDLATIGFFIAIATGVHKGNIFRTLISGSVIMFITIWISNQMYPLEIALGHATNLLAKGKQVSSLDQAGSPITYLLTKGFTGQVGIGFIVIAILFIGAFAYTYIAYKRQRLYVTDDKEK

SEQ ID NO: 6240 - protein, 164 aa, Lactobacillus casei
MALLNKNLIHRNATFLDADDALKSMAAAMVKNQYVKSSFVDAVVNREHQFPTGLPTGGIMVAIPHADWTNVNRGTISVATLKEPIVFKNMGDPEEDLAVRLIFMLAVNEPHAEVTLLKDLMGIVQNQATLQGLLDAKSDDELFNRLEDMFRDVTVDTGEKEQLK

SEQ ID NO: 6241 - protein, 99 aa, Lactobacillus casei
MKKIIVACGSGIATSTVARNALEEKLKAKGIDAAQVSMDQTSIPQLRSKADQFDLAITTGKFTEDIGVPVLNGLPFLTGVGEDELVQKVIDALDLKPKA

SEQ ID NO: 6242 - protein, 286 aa, Lactobacillus casei
LKYFGVTLASAEATHITRDNFFEPLDLTIRKRLLFNYALKNRRWIKVNGFLRRPGDWINEKEAFEVTNLTSRLPLEQLQRRYPDYYPLINKSQWLQHRDEAQQLFDTFIPKVKRRKRARYEDEIMEFCQDNGFQQIDSLRTHTARSAGAYVIVLDDYLSIYFSVVPNIATAITAHWDALLDLDAITALDALPIDAFKPLDTTRIFVRTTEKRNLEKLKNELTDLVPYRYTLNQSSPGLPGMGSSQETNLALFPKGVEVHDAMGGYELFEYDLAHELNIHPRKDDKK

SEQ ID NO: 6243 - protein, 410 aa, Lactobacillus casei
MDDKLKIIELLKHQVTAKTAELTTENIQKTTQDIQDLLKILNDVAAIDFVATPSETPTKQELATTSEETTIESPAPKPIVTTQVEKHEQVPQQPKVSSEPEVPLLSEHWLNNHKSYIGRFHLDLNGGHVGSIKVSESKLHKMSNPPENGDWVRADEYKDGDSMNYKMTTLKRDPLPTDIVRLKFLPAVFRQDVKRWYIEFKSPEHETTQQLLLGDYDVMLFKLKPGDYIDYAYRRGQEIDGKIIWRYTNSAAVATRMKQKFAKASDTESNHETAASRQTQYKATVNKPAKRKQRALQQVFANKQLLLVCIENSGMPRKVKRNVEERGGKLILSPRSDSNAMLKKKVQKADVVIVPTDFVDHGQMFAAKDEAKRIGKPIWMAKNTNERNMLQWYKRHFPNEAKTPAMDYEA

SEQ ID NO: 6244 - protein, 406 aa, Lactobacillus casei
MSQFDTLFDRKAGNARKWADQVLAEKFGLTPDAIPMDLADLDFPVAPPIHQAMMARAAVPDYSYTYIPEAFYTAVIAWNARRFGLKLEKDWIKLSYGTVPTLHYLVQAFTAPGEAVLINTPAYDPFAEAVQNNHRQLVTSPLAIKEGRYFFDFADMTTKMQRPDVKLFILCSPQNPSGRVWTAAELAKVAELCRQHHVLLISDEIHRDIVYPGVNFTSIWQADPAIQSQCILCLSPNKAFNLGGLKTSYVVIPDPAIRARLSQQFSANSITSPNSFAVPALIAAYTDCDAWLDEMVAYVAANFDYLKTRLAAISEMKVMPAESGFLAWIDTHRLFPDETSMKQFFTAADLSCVVGSYFVADGEGFVRLNIGMPRPLLKEALDRIIANYAEWPAMEEDSCKIARNTE

SEQ ID NO: 6245 - protein, 359 aa, Lactobacillus casei
MSHLTKLQEALEAEALDALLLHDRPSKRYVGALPGSGVYVIVTPTQALQLHDGRYRAEAADTQGFTNVEVPQGSYLPQLIDCLKTQGSQRIGLVSSGFSIAEYQALASQAWALTLADDLVARQRTVKDEAEIAAVTAACAVTDTIFAQLLPHIRPGVSEQTLSAWLHFYTLEAGASAMAFDPIVASGPRGAFPHGRPTARRLEEGELITVDFGVVFDDYQSDMTRTLAIGSPAPELAAVHEAVLTAQQTAIAAIKPGMQGREVDAIARGVLTAAGYGDCFTHGLGHGLGLGGDQPILNPRSQTILQPGMIVTVEPGAYLPGIGGVRIEDDVVITATGARVLNQTPRHLIQLEVVENEPV

SEQ ID NO: 6246 - protein, 441 aa, Lactobacillus casei
MFNKFEAFMNRFFMPIAHKVDNQRHLSAIKAGMVAMTPFTILGSIFTIIPALPNMLGPKNAVSQFITSNAALFDLPVKLSIGMIGLYACLSIAYNLGNHYKLYIPGCVTLSGFAFLMMVATFNKAGQLDVANLGARGLFTGMLVALLTVELYHWCKTHHLTIKMPEGVPDFVSRSFELIPVTLITGGAFIAGRFAFLNIAGELPPSILTRFLAPLVGSMDNPWAVLALNFAICTVFFFGIHSSVFSPITSPIMVTFIAENIAAMNAGEAIPHFYTAGAVSSFFGFTGCGISIGCVVACMLSKSKRYRKIGKISLFPALFGINEPILFGAPIILNPIMFIPHVFGGAIIGTLPMFFMHWGWIAKPIFNPPYVGVFLEGFLTNGDYRTILANALQLVLAVALYWPFFKVMERVELRDEAKKAAQKSIFSKEDEDTLAGLDLDF

SEQ ID NO: 6247 - protein, 112 aa, Lactobacillus casei
MRILLCCAGGFSTNMLMQNMAKVVKDSRKLNEADFHFNAIPVDGLEDEIDNYDIVLVGPQIGHKTGYISEICEPRHIPYAVIDKDVYGQMDGATVMKLALVTHAKYQKKHAG

SEQ ID NO: 6248 - protein, 105 aa, Lactobacillus casei
MATTQELEIMQLIANAGESKTKAFEALAAVKTRDFDRARNLLAESKEIDVAAHNAQTAMISREFDPDHTPEPVNLLMVHAQDHYMTSQLARDLIETMIDIFESRA

SEQ ID NO: 6249 - protein, 346 aa, Lactobacillus casei
MDLQLMAALSNADAIAANEGEVRNILRHYLAPCGFATQTDGLGSLIFTKRAAKPQFSIMIYGHMDEVGYMVRTITPEGLLRLMVVGGVKPAASHWQSVRVTTVAGEKLPGIVIRDESLPAFDQVLCDVGANSADEVSALGINIGDMVTFATEFSEYATKGVFGGKALDDRLGCYVGARLLTELADKELPFTLHFAATSSEEVGIRGAKTATQLIQPDLAFIVDVATFQHPRERSEVNQRQVGKGPILTHFDRTLAPNRQLQQFVKETAAAASLPLQLDMFNGGGTDGGEAHKVGAGIPTVVTFLPCRYGHCAQSLAQAADVDHMVALYAAMCRQMSLQLVEAAHTF

SEQ ID NO: 6250 - protein, 612 aa, Lactobacillus casei
ABCHPERNREGLATRLREHMIIQALQANGAMSAAALAEAIGVSRRTLQNDLRLLNRDATGFQICFQRGRGYQLQVTDSQLLADYLAAMKQQAQPQMPAKRIPELLRLLLTTTQYLTVATLAETQQISPKQLQRDLRELDKLLVGTPLTLERKAHYGVRVCCHWQSRILALQQYGLPPRHSTLTQQVQPLGLDPPVTAQFASEIGWSLAVTGQQPQPAPDDAPFADVVTDIRLGTEAWEFLIVSFAAKRKQLTTRLDHDRLKAKLQAYFTALDERHETNFATHPEFLSLMYFHVLALIGRLQEHQSLAGLNLEPLARDYPIAFNWAVQFAQWLSQEYQIDVPKTEIGYLTTHLLVPLEQAHEKWSRGGYRIAVVCGTGGGIATLLCLRLRRIFPEAMIQTFGLNELTAIHELSPDLLFTVTTLNESFDCPVIRIDEVASDLDFAHLRHELSVASRHNATASLADLLVPSLFFQQSTPTDYRSLLTTVTATMADYCGQADYAASVLQREDFLPTIYDNGIAIPHPLSFNAKKNAVAVILLPNSATNTTRPVHLVWLIALKQDQLPLHRTLTMQLAALMQKPDAINKLVQQTEFSSFHQILRTALEGAESTWIYN

SEQ ID NO: 6251 - protein, 198 aa, Lactobacillus casei
MNDIKGLDALLKKYHTFVSGTARRYGISSSMLKSAVNIGRISREERGVYVEDGYTWDDFAVLSQRYTKGIFALDTALFLHGLTDQLPDRFIMAFPHGYRNPRLAEYGVVPIYYVSDRYFPGITTVETPNMGIVPVYSVERTILEFWERADVAPYMRKEAINNYMYEYGNSVESYRKLKELKEQLYPRSDIFKLLEVLN

SEQ ID NO: 6252 - protein, 415 aa, Lactobacillus casei
LTIDLDLAQIQADFIRYAKINTRSYPGRDTTPSTPGQTELAKLLVQQLQDLGLQDVGLNAKNGFVTATLPANTDKPVKSFGIIAHLDTADYNAENVQPQVHPHYDGSPIEFANGLRLTVEQFPALKQYFGQTLITGDGTTLLGVDDKAGIAGAVATARYLLAHPEIKHGLIKFGFGPDEEIGVGADKFDAKGFATDFAYTLDNGDPGQIEYETFNAAQATVTIEGTSVHPGEAKGLMVNANTLGRQLDAALPAFDRPEFSAGHEGYFLLLKFHGEISEAQLTYIIRDFDHQQFEARKAYFKKVIDELNAQFDHPRLKVSMYDQYYNMADIINKDPYPLRLAEAGIKAAGLTPKTVPFRGGTDGSKITYQGIPTPNLFNGGINFHGPYEVVSTEAMGKIAETLIHMAQLNADGTVV

SEQ ID NO: 6253 - protein, 546 aa, Lactobacillus casei
MFRSKKWLLALPSAALVLLAAGCSSSSSGQSGQSSTNQTLNWSETSAIVTNDPSQSTDTVSFQVLNNTQEGIYRLTDKGQKPQLALAKKVTTSKDGMTYHVTLRNAKWSNGDPIRAQDFVYSWQRTVDPKTKATDAFYFAPVKNATAITKGTKPASDLGIKATDSHHLTITLENPTAYFKKLLAFPLYYPQNQKVVEKYGKKYGTSATTQVYSGLFKLTKWNGTGDSWTLAKNPQYWDKKHVKLAKVNETVIKDVQTGMNLYQTKKLDSIVLTGEQAAAHLNDKDAVKRLSSNMTRVDLNQKQVPAFKNLKVRQAFSMMINRTALTKNVLKDGSKPALGFIPVGLHTNQKTGADFAKTTQVKSAVAYDKTKAKKLFEEGMKESGQSQLNLTLLADDTDVSKQVAEYLQGAFENLPHVKVTIKSIPKAQRLQAMNAGNYDMVVTVWQSIFADAYNFLDVWISDSSYNSSGYKDAKLDQLLSETETKYGNDPQKRWTMLQDAEKILMKDQGTLPLYQADNLQLLRSNVKGLSFNPNGTPYDFKTAYLK

SEQ ID NO: 6254 - protein, 189 aa, Lactobacillus casei
MDKWSLRDVVLLAFLAFLFGGVFMGADAIYALLAAALTPIGYAPFANEILFGMWVMAAPMTAMLLKKKGSSILGECLAALSEMLYGSYFGPAVLLSGFVQGLGSEAGFIVTRYRRYDTVSLLLAAVGTTVFSFTYEYFKLGYGAYSLGMILALVTVRLLSVIFFGVVLVQLVMKLYEQAAGVKRLAGRS

SEQ ID NO: 6255 - protein, 448 aa, Lactobacillus casei
MMGIELRKLRFQRDGPLFDGLDFEFTTGAMTVLTGDSGSGKSTLLNLIAGFAPLTYEGTILVDGQDNRNASMQTKASRVGMLFQNPDQQFTMRTLRGELNFALENLDLPADVMAKQIRQAVALGETDDFLDRDLQTLSGGEKQRAALTVLLAMDAPVLLLDEPFASIDPASRQQLITKLGKLRDAGKTIVIADHDLSDYAGVADELVSLKKGQLIRLPLATLTTIPTHFHLTQTDAATTPLFHLDQVVCAQNRRVLIRAADWHFNTGITTLTGANGSGKSTLLRAMVQLHPYQGRMFLGERRLWRRQRLFQTMTLAVQDATKQFVTLTPADELKFGAPLTAEVRERQQAALDYLGLTEKQTGSLYHLSDGQKKMIQLIAMLSLDRSFLLLDEPFSGLDERACAFFTAWIKEKAAEEAFLIVTHRLAPLAGVSQQHVRLADQHLAVLGE

SEQ ID NO: 6256 - protein, 215 aa, Lactobacillus casei
MLPKKTNALNLSLLILLLTLEISFSHSVKLDLALIGLATGFLLWRRAFKSLVVLALLPMIPAASTYWAITLHGTDTSYALLLFVRTYAFAALGLVFLIGVDLEALLLWLEQHKLSPNFVYGLLVVIHALPQIMHEVAAIREASLLRGQKLHPWSPMIYVKVIFVAMSWQDEYVKAMYAHGYTEGAKRNVRRAIISSRRGLVAAAALFLLLNVLVR

SEQ ID NO: 6257 - protein, 230 aa, Lactobacillus casei
MKFSELARQQVVPYWEGSLSHPFLTELQDGTLDSTIFRFYLIQDAYYLKHFSHLYALIAKQAQEPELKTYAEQSAAGLAAGELAVRQDFFETLAITDDEVAATAIAPTAYHYVSHMYRQLVEGTPHVAIAGMLPCPWLYQEVGQYLAQRQSPVPIYQRWIETYSSDENADDQQAAVALVDRLYEHSTPAEQQQMIAAFKISSQMEYSFWEMAYRLEAWPKGRIADGAKPR

SEQ ID NO: 6258 - protein, 166 aa, Lactobacillus casei
MGQNRVKRLAMLAMMIALDVVLSPLFRIEGMAPMSSVVNVVAAVVMGPLYATVMAFACAILRMTLLGIPPLALTGAVFGAFLAGIGYRLGRKNWWAAAGEILGTGLIGSLLSYPVMVWFTGSSQSLYWFVYTPRFFGGSISGSLIALFVLYELDHNGITRRLQKIF

SEQ ID NO: 6259 - protein, 280 aa, Lactobacillus casei
MTQSITEVFADAFKTTFPLKSSPLVDCITNPVTIESMANALLYIDAKPVMADLPEEFPKLFTQIDALLLNLGHISPERKDSLLAAGRYAAETHKPAVVDLVGVAATQLRYDIGQQLLQNHPNVVKGNISEMRRFAGLKSTGRGVDGSQLDQSATALAELTKALQELTERFPNTTFLATGETDLVVSAKGQWRLENGVPQLDRFTGTGDIVGALTAALLSIGLSNDEAVVLTVSYFNCCAEVAAAQNTAGGIASFREKTLDQLSLLADQADWVQMVKGEAL

SEQ ID NO: 6260 - protein, 209 aa, Lactobacillus casei
MKPEDLKLYLVTHRYDESQAAFLAKITAACENGVTMVQLREKQLKTRDYYALAEKVKTITDHYHIPLMIDDRVDIALAVDAAGVHIGDDELPVAVTRKLIGPDKILGVSTKTLATATAAAAAGADYLGVGAIFPTPTKPDSPVLSIETLKTITASVPIPVVAIGGIKESNLDTFKNTGIAGVAIVSEIMQASDTAQKVRAINQKLKEVL

SEQ ID NO: 6261 - protein, 278 aa, Lactobacillus casei
MGSVNRTPQVVTIAGSDSGGGAGMQADLKTFQARHVFGMNIVVALTAQNTYGVQASLPIPTYFIDAQFQSLAADFAIKAAKTGMLADSEHVEAVVRNLQQVDFGPLIVDPVMVAKGGATLLEPEAVATIKSKLLPLADVVTPNLPEAEIIVGKPIKTNADTVAAAQTIQQLGVKNVIIKGGHRSEDEQAADYILLEDGSSFWLSAPRIATANTHGTGDTFSACIAAELAKGQPLKSAIVTAKAFLQGAISQGIFVGHGHGPTNHWAKLSDKVRMSETR

SEQ ID NO: 6262 - protein, 337 aa, Lactobacillus casei
MKKKVSITDVAKETGLSVTTVSQILNGKGARFSEASRKRVLAAKEALGYEPDLFARGLVGKRGNSIGVVIPDMMNPFFASFVVSVEKAAIPRGLFPQIFSINGFHENVDYFIRQFLGGTQRGLILAAPEASQEIVQKVGHQLSLPMVFTDQATTLMTGDSIRIDERHAGFLVADHLLQLGHRRIALVLPELLTINLQDRLAGYQQAFATHGVTFDQALVFRSSFDPEGGRQAVAQIVKSDATAIIAINDDVASGVYRGLYEQHKRIPEDYAVVGFDDVTQARFMTPGLTTLAQPVDQLGQQAVELLVAQMSGEHNTRNAVELPVKLVKRGSTRYVTL

SEQ ID NO: 6263 - protein, 309 aa, Lactobacillus casei
MPNHVVVIGSINVDAILHIQRLPKPGETMEMDAFSQAAGGKGANQAVAAARSGAKTSFIGRVGDDANAAFMRGELVKNKIDTQYVSTTSGEQTGQAYILLQASGQNSIIIQHGANFDLTPNDVQKAATFIQTADFVVAELETPVDATTEAFKIAKAAGKVTILNPAPAQKDLPLTLLKNVDLITPNETESELITGIPVTDETSMRASATYYHELGIRGVIITLGSKGSFISLDGQATIVPAFKVKAVDTTAAGDTFIGALASVLQIDLKNIVEAATYASMASSFTVQKLGAFPSIPLGDDVKAALNEHK

SEQ ID NO: 6264 - protein, 662 aa, Lactobacillus casei
MKKTTLTVIGGVIAAVVIIGGGFGFYHWYQAKSEADAVQATAQAYTQAFAKRQYTKAVKQVDTKHLSGPGWDYTPKTLVARNQAVFDRVGASNIKISKVTTKKQDAKSYKMTFDATMNTKVGKLNTQHYDASIVKSGNKWLIRWDPSLLFPSMYGKDTVQLDVTAATRGQILDRNDQPLAKNGDVTQAGLVPGKLGSGDERTANLEKIAAAWNVKVTSLETLLKQSWVTDDTFVPVKVVTDSPTLTGAAYQTIGSRTYPLGEAAAQLIGYVGTATAEDIRKDPTLTANSKIGKTGLEQLYDKQLRGTDGGTISIQNGSNVHPLLSKKAVNGKNLKLTIDADQQKTAYAQLAGKSGSVVTMNPKNGELLTLASAPSYDPNAFVNGISQTDYDKYANNQSLPFLSRFAQRYAPGSTFKMLTAAIALQNKTITPDTTKSISGLKWQKDASWGDYKVTRTVNASPENMTQALVNSDNIWFAQVALKMGASAYLKGLAPLFKTQADLPLTMKKAQISNSGKLASETLLADTAYGQGQLLLSPIEQAAMYSAIANGGTMQQPTLIQDTKGKRTSVLQANAANTVKTALTHVVSDPTGTAHDLAIDGHTIAAKTGTAELKQKQDTDGKENGFLVAMDADKNSYLTVALIEGTGSGEVVTVMKPYVASLY

SEQ ID NO: 6265 - protein, 218 aa, Lactobacillus casei
VKEGEIVGIIGPNGAGKSTLIKAMMDLIPHQGNAAMDGQPLAKQAQKIAYVQQKSNIDLTFPITVRECVALGLQAHANMFGYTGKNEGRAIAQALEMVGMTDFAKRQIGRLSGGQLQRVLIARCLVQEADLIILDEPFAGIDNRSESAIMIVLRKLRAEGKTILMVHHDLKTVRSYFDSVVMMNVHMIGAGPVATTFTDTNLEQAYGLPMHVNQGGQS

SEQ ID NO: 6266 - protein, 281 aa, Lactobacillus casei
MKLIFLHDLAEFHFLQNALLTSITVGIVAGVIGSFVILRGMSLMGDAISHAVLPGVAVSFMVGVPTVVGAATFGIAAAILITLIRQHSLIKSDTAIGIIFSSFLALGVILIALVHTTTNLFHILFGNVLAVQDKDMYLTIGIAIVVITLVVLFFRRLRLTSFDPVMAQAMGIHTNAYHYLLMVMLTLVAVVSMQSVGTILIVALLITPAATIYLFANRLRTMVIASGALGGLISFVGLVIGYSFNIAVGSCIVLLGTFVFIVCFPFSKKQNLIKLPIGGRS

SEQ ID NO: 6267 - protein, 319 aa, Lactobacillus casei
MKNKNRKRVLVQAAIVVTALIGLTACGSKNKSSDKAAQSGSKISIVATDTIIGDIAKNVAKDKAKIHVIVPVGQDPHEYDPLPADVSATGKADAIFYNGINLENAPGAWFTKMMNNEGSKAKAKAVAVSDGVDVIHLQGKGESSKQDPHAWLSLANGMIYTRNIAKKLEKVDPKNAAFYKRNAATYEAKLNKLHQSAKNKFDKIPAEKKLIVTSEGCFKYFSKAYQIPSAYIWEINTEEEGTPEQISTLVRKLKETKTPSLFVESSVNPKPMQTVSKDTGIPIYATLFTDSIAAPGKTGDSYYGMMKWNLEKIAAGLEK

SEQ ID NO: 6268 - protein, 460 aa, Lactobacillus casei
VIKRWLILITLGLFFFMVIIDGTIVVVAVPTIAKDLAVSPSQVNLLLTVYLTTISVCLLFFGQLADQYGRSRLFIWGTYLFLIGSGLAGFGSHFQLVLAARVVQAVGASMTMATSYAIVADVFPPALLGRALGIESIFISAGALAGPGLGGLILSRLPWGYIFWVNLPIGLLCLLIEWAVFPRVTAASGKRRVDHHGFLQLIVIGGLLLLLQINHVPMLTVGLLVLIGGVTYLFWRHERQAPDAMLDTRLFRNQRFSRNLAASFLNYVAAYFFTLLAPIYLQLILRVPVAVSGYLLMLTPLTALVANPLAGFLTDRCDRRRLMVIGLLLLVVTNAAFALVPNQKVLWPFVIVSVVFALGTALFTNPNSVVLIQSVDASMRGQVGAATSLARQLGMSIGSAVAGLVFYQTLGLIRPNVTAANAGAPALLTAQCVSFLLAAGLFLIAAVILGKKVKDAKRTG

SEQ ID NO: 6269 - protein, 144 aa, Lactobacillus casei
MQKEPDELIAKVNILARNIQHDLDEALAPTGLNASNYYFILKLGTADEMSQEALFKMIHLDPSNVTRRLAQLVTFGLVVKRRSDKDKRAWVISLTPKGRKLVPRVAQIVAGYEEMLTEKMHIDNKTKFGHMLDQLIETEKELEF

SEQ ID NO: 6270 - protein, 187 aa, Lactobacillus casei
LKNEFMNLLPIPQDFHVVETNVRKRNRASVTVERFQDTDDITPNNKHLTVVTDQKGHLISFNSSAFKNGGHLPAADKALEQAITLFNQLDPDYAAGLSYMRTERQERHYEDNGVHVSAPVYWIKFAHRNGSYNWVTIGPDNQVIEVERESLWDYFGNRRATEMWNNDNWVLAREGKAPQLSAPDALA

SEQ ID NO: 6271 - protein, 71 aa, Lactobacillus casei
MAKPDFDTLIRRLGDLQEEARRLEEEDYISARYKGYSSEGLTLEEVMARLKKVEREIAKLEERLTRLDDEV

SEQ ID NO: 6272 - protein, 118 aa, Lactobacillus casei
MNNPKFESYKRPNGHDEFKEWLYALPEKDAAKLLRVIEETEKNGMLVAQRLKWVKKISSNLYEIRSNVASNIQRALYFHVTDNRYIITHGFTKKTNQTPAAEKKHAEELRKEWYAHEN

SEQ ID NO: 6273 - protein, 88 aa, Lactobacillus casei
MKIDDMIKEKRKNPEFNKAYEAEGEKLATAVALYHAREAAGLTQAELAERADTTQATIAKIERGDNVSFEKLQSLAHALGKKLIVKFG

SEQ ID NO: 6274 - protein, 77 aa, Lactobacillus casei
MDIVLEARTVQLDNSLALILPKGKGFAEKQIWLLVPLDDGEPGYTLTPKLKDPYVGKKKGSMYVPEEWPDFGYRNVE

SEQ ID NO: 6275 - protein, 550 aa, Lactobacillus casei
MTYRIDHNLQYLTQLLQKLRKAHNFVNLFTYNSKRIRGGGLILKKWVKVTGILVLLGAILVGCSSSASSKSSSSSSKSSKTTSTKVTSGASQQTYTDPKMMKGKYDIVIIGAGGAGMTAAIEAKQQGMNPVIFEKMPVVGGNTLKASSGMNASQTKVEAAQSVKDSNDLFYEETLKGGGGTNDKVLLRYFVDNSASAIDWLDSIGIKLDKLTISGGMSVKRTHRPHDGSAVGGYLVDGLVKEVKKEKIPLFVNTDVTKLNETNGKISGVTVKINQDKTKKIAAKAVIVTTGGFGASKKMIKKYRPDLANYVTTNQAGATGDGIKMIEKVGGYAIDMNKIQIHPTVNQSKHILIGEATRGEGGILVNQSGKRFYNEMNTRDKVSAAINKQKGKYAWVVIDSGVRQRSSAIDFYIKDKLDVKGNTLAELAKKMKVPAATLAKTVATWNKAVSSKNDTEFGRTTGMDHGLTTGPYYAFKIAPGIHYTMGGVKINTKTEVLTKQQQPIPALYAAGEVTGGLHGNNRIGGNSVADIVIFGRQAGTQAAAYVKSQE

SEQ ID NO: 6276 - protein, 102 aa, Lactobacillus casei
MKKVLLICGSGASSGFMAAAGRKAAKKAKVDLEFKARSDSELDDYLKGNDLLLIAPHLKYMLADATKEAAPFGVKVAIIPQKVYGSLDGAGLVKFAEEELSK

SEQ ID NO: 6277 - protein, 119 aa, Lactobacillus casei
MGEKVNEEQETFDRDDLNEISMQVILHAGNARDQLLNILDKLADPTIDEAVIEEDFANAKKELNEAHSKQTTMIQKEAEGEFIPYSVLFVHSQDTLMTVQSELLMTEKMIKIVRSLRDS

SEQ ID NO: 6278 - protein, 444 aa, Lactobacillus casei
MQHFMDWRTDSFAPKVNKLAKNPWIAAVQDGILAAMPMIFIGSFATIIGILRNYWPAIPDISYISTFSFGLFSLFLSYLVPEAIMNRKKHKDVSRQAGLAGIAFFLLLIYPSISAKGIISFDVNSLGTGGMIAALVAGIFVGFVMNIFAKMQIFGEDSALPDFVAMWFNTLIPIIVILFVGWLFTFQLHFNLYTGINDLFKPLLALGGGFWGFVIINFIGFSFLYTFGISTWVIYPIQSAIALPAIAENAKNFAAGAAVTNIYTNEAVDLYIIGGGGSTLALCIMMAFMARSARLKVVGRAGLIPSIFNINEPIIFGAPVAFNPLLMVPMWIMGLIGPIVTWFALSWRLVPIPHSVFQLWYAPFPILGYIVTDSIAGVIFTTIMFAISWLVYYPFFKAYDRQEVKNEASDDEDEEKSDESEVSGTGPDDGVEAIVNVEVATGAN

SEQ ID NO: 6279 - protein, 660 aa, Lactobacillus casei
ABCHPERNREGLATRLKVNDTDIVEFLRKRSGWVTAETIARQFGVSPRTIRNHIQSINTADLAVLSGPLGYKAKMLLHGWKEKVDDQESDIGQKLLYELLDSHGSSVSLDEFLANHYLSESSARDIIRDFNRDHSADNVQVVEKKRQLRLIGDESDKRRLFKSFLHSNRSASVPEVNIQRIQRLIPDIPLLDMEKIVNETVNQDSLTINQYQLFDLLMHYAISVNRIQNGKAMHRLSATHEELTGRNEYKLTLRITAQLEKRYYIKFSKAEIDGLTLALIGKTIIKNFSSMHLGNLSRFVPERVIEETQRALEKADEEYGFNLQNPSFSVKFIIHVNNARDRATYHDLDQQDVNQFSLLKQEYPLYYDLALYIGKQLQNSLHLTMNSQELTYIILHLGAYLNTDDIDRINTVLISPSYYDIGNELKTNISREFRQDIQISAVYNALQVEELKKLRSKLVVATIDTSIPFDKSNYVVRIHPFMTSQDHEKIERTISVIRRANRVDEIVGYFKQYTSADNFLIDPQISKRDALFSRVTKLLTERGFVSPQYYDELSEREQLSPTSFGNIAIPHPLNMKANKTGIFVVIDHDGIQWHSSTKVNIACFIATSKANQKVFSIVLQNLINILSVKENVDQILKVDNYEDFLSVLIQILKGGYDTNV

SEQ ID NO: 6280 - protein, 479 aa, Lactobacillus casei
MSKLKYTDKFPKDFLWGGAIAANQAEGAWDVDGRGPSQADTMLLPDKYSRTVSLGTDMHKSDIEAALTDTKGNYPRRRGIDFYHTYPEDLELMHEMGFKCFRTSFSWSRIFPNGDEEKPNEEGLKFYDRLIDKMLELGMEPVMTISHYEMPVTLITKYGGWTNLKLIDFFVRFSKVLIDRYSKKVKYWIIFNQINDVSDWGEYAGLGILKGEYPDQLTARYQGVHHQFVANAKVVKYAHEVNANLQMGVMLGLTPVYPATSKPEDTMTAYNLWRREDLFFSDVLVEGEYPGYMIRYFHDHNIDVDVKPDELKLIKDNPVDYVSFSYYYSTIASADQPDKRQLNPNIEKSIWDWSIDPTGFRYGFDFLWDRYHLPLFVAENGLGALDKVEDGKVHDQYRIDYLRAHVEQMREAIKDGVNIFGYASWGPIDIVSYSQAEMSKRYGYVYVDLDDKGNGSGKRIRKDSFYWYQKVVESNGEDL

SEQ ID NO: 6281 - protein, 698 aa, Lactobacillus casei
MRERLTNLLRTLLDSSENSLSDLSKQFNVTTKTIRNEIQVLNEVLAEKGLPLFDIKRGVAYNHISTQQLHSLSDVLDFNSISQGALTPEQRKVYLLLDLLQARHPVYLVDEQGAMQISKSTMDADLRNLRADLAKYNLTLTTSPKLGAQIEGNERSIRTMFGDVLTRQHALVTLIGQQLIASGMYVDKMKEVFNQQDVTYISDLLLRCFPNGALAANDMYRQQVTVLLIIWLHRVRSGHYVKDDETAVDLNKGNTRFLNELIQHYDLTIDISSELGYVGFLINSFNRRGAIDLDDWVKAQIFSVALMDYMETEIGFPFSKNEKLFEELYNHMTALFKRLSRNMKVVNPLKKTIQQGYSPIYDAINRFFTAGPYQLTMSDDETAFLAMYFSATQAEDRQRQDYQYQAAVVCNFGTATGRVLAAKLEERFNIDVLAVLSTSEVGILRKLPVSLVFKTVDMPIEEIPSLKVNPIPSEVDLNRIAAFLKKYAALTKYEGRTLDPTRLFQSILDALKAHQVSVDKGLLADLQAAFKDNHVEINEREVQPMLKDLINDQQILLQQKADDWENAIRLSAKPLLDEDYITEHYVQAMIDSVKKFGPYIVIGPSIALAHARPEDGAKKLGVTITTLAKPINFGNPDNDPVKIIFCLAAIDNYSHLNIMKAIVQLINDQQKVDQLAQQTDIQQFKTILFNEKTSKETI

SEQ ID NO: 6282 - protein, 103 aa, Lactobacillus casei
MSRKLTIYFICGAGLGSSLACQMTAEDVLNRLGLDENLEHEAISSTPGLRTDIIVSAENFASQFKQYDLDPAIKFVFLHNIVDPAEIEAKLVPVIKELSAKAS

SEQ ID NO: 6283 - protein, 428 aa, Lactobacillus casei
MVVVNFIIQNILTQAAITIALIAMLGLLLQRKSFGAVLTGTFKTLLGFQVLSAGSAIIVTALTYFGKIFQHGFHLQGVVPSIEAINGQAMNTLGLGNEIALTFLGIFIVNILIARFSPWKYIFLTGQALLWMSTMTVVGGKMAGLNSVLTIVVGSIIGGIFAVAMPAIAQPFVRKITKGDAIALGHFCTIGYMVEAGAAWVFGERGEKKHSIEDIKLPKYMEFLQDTYLSVAVVMVPLFMITAAFAGPKYAGNGTSLNYIMNAFMMGIQFVVGVYVLLAGVRLLLGEIVPAFRGIAMKLVPNAKPALDCPVLFPFSPNAVILGFITTTIGTVIGMFLMPVFGLAVILPGMLTNFFAGGTAGIFGNVVGGRRGAIIGGIIHGLFITLLPALLVTALTSFGFVNASATDSDTIVAMLMYAWILTPILKAV

SEQ ID NO: 6284 - protein, 140 aa, Lactobacillus casei
MFGGLFKKKDAQRPSSAVSKQRDQPISSTDAADLKEKVASLTEQIKRTTDDKEKRHLLYNQLGAVQAKLGNDLAAIAAYEASIKDKEEFGDAYNALLNLYEVQRKQAAKAKNDDDIQKWVSKTDSLLDMSKRVMRSGFGY

SEQ ID NO: 6285 - protein, 286 aa, Lactobacillus casei
MYKNLKQLMDEAQALDYTVGAFNAHNLEMVPPMIMAAKDAGSPIIIQTSVATAQYVGMKNFVAVCKSMAQDLLVDVDLHLDHAKSFDAIKEAIDAGYSSVMFDGSALPNKENMERARRVADYAHEHGVSVECEIGTIGGTEEGVTVKEGRYTDPQQAITFLNHVDVEALAVGVGTHHGQFKSKTKLNWPLIEELHQEISTPMVIHGGTGVNEADYHRLTENGFRKFNVGTELLVGWTRKAKEMFGQTEVNNSLRNNIEPCNQVVYDIVKHKIGLFLNKDAEVPVNA

SEQ ID NO: 6286 - protein, 213 aa, Lactobacillus casei
MAVDTQALVLLAGAPGTGKTYAANKIMQAISGFVSLPLDLFKEHLYDELGFDNLQEKQTLDAEARTRYYRGIDILMSEHKMILGDYPFSRLQKPALEKLAAKYHYPVITIRLEADIKVLYNRQRQRDLSDPRHLGHLMNHYHRGDTLESINEKPDGMPSFEVFSNRVCDRGYQNFQIGRLIRVDVNDYAKVDYQTLVARLKEFLKASAVGQIG

SEQ ID NO: 6287 - protein, 289 aa, Lactobacillus casei
MIKILLGLIVLINLGFLFYFVRDLLRHRSEVMTEPATTWALPFSSFLIFLLSTFGISDFAISTALYPKVKWVSIKKLPGTLNTQCVIPVAAMALSYITAITVDIKTLAICIIAAVIGAYIGPQFVVKLPGDTIKKFVTAGLLIAALMILAGKFNWIPANGTATSLSGWKLILTAVLLFVYGALNNIGIGSYALTMATVYAMGLNPSAAFPIMMGAATFSVSTSSIQFVKLADYSRKITLFTSTFGVLGVLVAVFFVKSLDTSMLQWLVIVVLLYSVISMALSLRQKEEA

SEQ ID NO: 6288 - protein, 46 aa, Lactobacillus casei
MRILTKKDVQAVYTMKDAIADDKVALAAYSKGDATVPLRANIDVQA

SEQ ID NO: 6289 - protein, 278 aa, Lactobacillus casei
MPGYAAGEQPALGVKIVSVYPDNIDKGLPSVPATMVSLDPKTGIVSAIIDGTYLTQLRTGALQGAATDLLANPDAKVATLIGTGGQAPTQLEAMLNVRQLTRVYVSDIDHERAAKFAQDMTARFGKQFNADILPVNDLSKAIRASDIITSVTTSKQATFDAADVQPGTHVNGIGAYTPEMHEIPAELVQRADSVIFDTMDGVLAEAGDMITPLKEGLVTKAHYDGELGQLINGKIKGRQQHDQVTLFKAVGTAVLDVVVAEKILQAADKQHVGTSVDL

SEQ ID NO: 6290 - protein, 311 aa, Lactobacillus casei
MSTTSPAPTIISTDPGIDDAVAIAIALGSPMLDVQLICPIAGNVSVEKTTLNTRRLLTFLNKAPRVVQGSSKPLLRPLKDASGVHGKTGMDGYPFPEPAMEVDTSIPAAVAMHETVMANSRPVTLIGIGPLTDIALFIHQYPDDLKKIKELVLMGGALGRGNLGVLSEFNFGTDPEAAKIVFNSGLPIRVAPMEIGRQAKILPETSEKIKQLGKVGDMFYALFSKYRGGSFKTGLNMYDALAVAMILEPSYFNEVTTHVEIETRGEFTAGASLIDLKGYLGKPDNASVATNVDSEKFESWFVDAIAATASL

SEQ ID NO: 6291 - protein, 468 aa, Lactobacillus casei
MNAILVSVIGILAVAILVYMLLKKNDIKMTLLVLGITLMYLAIFLGNKIKVSASTGTVWLDPFQAVVDQFTNTLVGPGFVILILGGYSAYMSHIGANHVTIQALTKPIAKIRSVYILIPIVFLIGNLLSLVIPSASNLAIILLATLYPVLRAAGMSRLSAAAIIGTSATIVPTPLGSDNVAVAAQLHMAVTDYVFKSHALVSIPTLLAIAVVHYFWQKHEDKVDPETLTYDKEVAENHDDGIDSKENVNSYHGLTAFVYGLLPLLPIVLLLAIFFTNIVAGTKLNINVQLVTLISFVVAVIVELLAKRKVQNVLKGTNSFFTGMGDVMSIVALLVAAQTFVQGLTSLGIIELIQNSMTHMSGSGIVLPIVMVLFTAVIVLLSGSGTALVFAMIPLIIPLSKAAGIDPVALSIPLQLAGNLLRAVSPVAAVVLIVAGTTKLSPIQIVKRTSVPMVFGVVMMLVMSLILF

SEQ ID NO: 6292 - protein, 245 aa, Lactobacillus casei
MHRSPKYVQIYNQILKMIKQGQLAPGSKLPSEEVLTNEFEVSRVTLRTALSLLKEDGLIRSIHGQGHFVEAGEKKTSGIETLGNPILKGLVPTIERREAYYHENQPSEFTDQLFDSHDEPYDTLNIWYQNNGENIGNTLAILLPETVTMFRINLNQPDSIINFLEKSVYQKASRSSVSITLSDRQQKSFRRTFSDTSPLILMTEDIFGLNGERLLQNKHYIPANLFRVNVVRIQHDLQSQISPVD

SEQ ID NO: 6293 - protein, 600 aa, Lactobacillus casei
MTNDRSTIAAGLAVVKVLEAWQVDHLYGIPGGSFNSIMDALSAERENIHYIQVRHEEVGAMAAAADAKLTGKIGVCFGSAGPGGTHLMNGLYDAREDHVPVLALIGQFGTTGMNMDTFQEMNENPIYADVAAYNVTAVSARTLPHVIDEAIRRAYANQGVSVVQIPVDLPWQEIPQDSWYASAINHQKPLLPVPDPDLVKKLTQQLVDAKRPVIYYGIGAYTAGKELQQLSELLKIPLMSTYPAKGIVPDSYPAYLGSANRVAQKPANEALAQADTVLFIGNNYPFAEVSNAFKNTQHFLQIDVDPAKLGKRHQAEVAILADAKATLQQVLEQVSEREETPWWKANLANRQNWRDYLSKLENKQFGELQAYQVLKAVNDIADEDAIFSIDVGDINLNANRNLNLTPKNRHFTSNLFATMGVGIPGAIAAKLDFPDRQIFNLSGDGGAAMTMQDLVTQVQYHLPAINVIFTNKQYAFIKDEQEDTNKNDFIGVEFDDIDFSLVAKAVNMKGFRVTKIEDLAPTFAKAKEIAKTEPVLIDAVISGDRPMPVEKLQLDPAKFSQEEIDAFVKRYEAQDLRPFADFLKEAGLSVRDAENSEGGF

SEQ ID NO: 6294 - protein, 503 aa, Lactobacillus casei
ABCHPERNREGLATRMTTDLAQSVIHLLQDQQGFMTSNELAGKLQVSYKTIQRVVSRINRAYGNNVITSEKGRGYKLDYERFLLSRLSGKSPRDLSLPAERQKELLKRLLLATPSKLKVADLAADFFVSESVIQSDVSSLEPWLKKYDLTVTRVNRTLSIRGEEKDIRDALMEVILGLSKDTTVNFEAVKQGLAEHDATFALKQVDVVEQFLKADLPYPYDVNLFSHIYVLISRIRKFVKLPIEDRDITRLKDKVHNYPDLFSVSEIVKHNLENYLGAPISENEVYYLFQYLISARFTGTDFKTKAGTSAYTFSDALITLVSQDVQLPDDAPAMIDELVSHVAPMLNRLENNIRLPNALLKEIQDEYPKVYQSVLHAAGKLTKKFDLPEISADEVGFLSLYIAKYVESSKKPKKAIVICTTGLGSSELISAKIRKDLPELEILDVISNLNLGKSLAKHPDVDILISTINLPEQKHIPQVLVSAMFTAKDKEKVEEALRGRRDG

SEQ ID NO: 6295 - protein, 156 aa, Lactobacillus casei
MVKPVILRFEPISEGEIKRPVDKQAVLRAISDALAKVSGQEVAQIQSAFLERERIGNTSLTSGIVIPHAVLNGRQSPILGIFNYPQGIQGWEDLDGHPITHVLAILMGKAGITEQEADDIKHFFMALALPNFLQKISDTKQSQATIAVIKQQLEEK

SEQ ID NO: 6296 - protein, 313 aa, Lactobacillus casei
MLVSGDRLLQVAKEHHFAIPAFNAGSGQLFTATLEKAEELQAPFIMAIHPTELDFLRDSFVAQVIDAANHTDLPIALHLDHGASYEQVIHAIHLGFTSVMIDASLTDYEHNVALTQKVVEAAHATGVSVEAELGTIADTGNDVEGHLTDNVQYTDPETAKEFVEATGVDSLAIAIGTAHGLYPKDVKPKLKPEIVKAVAAAVDVPLVLHGASDNPDDKIAEAIEYGINKINISSDIKIAFAKDLRTVLNENDPDEIREPKVLFPSPMIATQKVVAQKIKLFGDVDRTKLYYQNEPVNEIPYDVKNFQVEHFSA

SEQ ID NO: 6297 - protein, 157 aa, Lactobacillus casei
MEQIEDVLDPRLIKLNLEAASKRDAITQLSETLKAADYINDVPSFVQDIYLREQEGMTGIGDGIAIPHGKSDYVTKVGVAIGIFNHAIEWETLDGKGVSIVILFAVSNDTASARNQLKLLSLFAARLGHEEVIAKLKKATSPAEVIAAFTEKEGLEQ

SEQ ID NO: 6298 - protein, 118 aa, Lactobacillus casei
EIIBCACMPNENTMKIVGISACAAGIAHTYIAKEKILQAAKDAGDTAHVETQGTIGTEDALTPEEISQADIVLLAIDVKISGRERFAGKKVVEVPTDVAIKSPKKLIAKLHELTGQPS

SEQ ID NO: 6299 - protein, 373 aa, Lactobacillus casei
EIIBCCMPNENTMKKIQIKQPALTAISYLIPVVVAGGFLLAVGNIMGGKNLEAVKEMANIWDAFSTMGGLILGMLPIVVSTGVAFAIADKPGIAPGLLVGLISRVIGAGFLGGLIGGYVAGWAALIVIAYVKVPKWAAGLMPTLIIPFLASLIAGLFMFYVLGGPIAAGTVWLTGYMKTLDTSQKFLYGMIIGVLASIDYGGAINKTVFAFVLALQAEGINQPITVLILASMVTPMGYTLAYFLGKAVHKNIYTPLEVETLKTAFPMGLVEITEGSLPIVLNDLWRSIVATGIGGAVGGGFSMLWGADSKIPASGLFAVPTMSRPWAFIIALIIGSVVTALVYLILKKPVSTEDIQEEKEEEDLNLKDLKISD

SEQ ID NO: 6300 - protein, 326 aa, Lactobacillus casei
MTSEAFIGNEAQTSGAQLVQFLEGKATGLKAIRMYNQAGLSLLVTPDRGMDIPELKVHGINISFMSSTGLVNSTYFVENGSQGFMRNFNVGFLTTGGLSYMGASDDPQLGLHGTISNTPAENFGHQTTSSVVKVSGAVRETSMFGVNLLLKREVVIPKTETKIRIHDVVTNEGMQTSPLMMLYHMNFGYPFFSPDTRLMMNTVNPTDRDGKLAIDWNQFDQPQPGTTEKVYFHDFSDQSDKDFQYRLLSPTTGLQATVTISPSMLSILNEWKLTQTKNYVLGLEPATNNVNGLEAAKRDGTLQTIEPNEAVTFDLEVEFSKMEVSD

SEQ ID NO: 6301 - protein, 228 aa, Lactobacillus casei
MKRSEINHILKDSETFLKEHQVFLPPFGRWSPEQWQNLDESYQEITDNMLGWDVTDFGSGNFQEYGLVAFTFRNGNYREPKKYPKPYCEKVLLLKEGQELPYHFHRLKEEDTINRGGGNLQITVWNATEDEALDKESPVHIVKDGHQLVLVPGTVVTLHPGESLTTTTRIYHKWNVETNSGDVMVWEVSSTNDDNIDNRFLKDIPRVPDIDEDEAPYRLLFGDYKKLV

SEQ ID NO: 6302 - protein, 488 aa, Lactobacillus casei
MTNDVVLGIDLGTSSVKVMALQRSGKFYTHAEPLTLIHPQNGYNEQRPEEWVTQTFKAIRGVLSANQISREAVKAIGFSGQMHGLVALSADQQPLRNAILWNDTRSSLEVEAIQARMGQRYVDITGNRAVEGYVLPKLLWMQKHEPAIWNQIEKVLLPKDYLRLSMTGILGTDYSDATGTGYLDIAKGTWSQTVLDHFGISLSWMPELMDSGTVVGGLTKTAAEASGLLPGTPVTVGGADNAMGAIGAGVVKEDQLMSSIGTSGVVLHPEKSLNLKYQGRLQLERHALKSHFYSMGVTLAAGNSLSWFRDTFGGDKPFETIVHDAASSPIGANGVLFAPYLSGERTPYFDPHVRGGFIGISNGTTFNDFARSVLEGIVFSLNDVLNLYRQFGVLPTEVIAIGGGAKNRFWAQMQADIFDLPLKVPIVDEGPGYGAALVASVAAGWYPDVSSAIDALVRYGDTYTPIASNRDAYELIYKEYQKLYQRLV

SEQ ID NO: 6303 - protein, 160 aa, Lactobacillus casei
EIIABCCMPNENTMAMFTKDNMIMDLQGTTQKEILEDLAKKAYAMGAVQDAAALVSDYLAREEESTTGFGNGVAIPHSKSDNNLKATIIFGRSQQPIEWQSLDGQPANTFISLIVPTAEAGVHLQLLAKLSRQLVHPDFVNVLKNGNQDEVYELIDKTIQ

SEQ ID NO: 6304 - protein, 526 aa, Lactobacillus casei
EIIBCCMPNENTMANLKIVGVTNCPAGIAHTYMVAEAIEQKAKSLGYEVHVETQGANGIENKLTPAEIAAADYVILALGKGMSSEDKARFNGKQVIELPVSEALKKINVIFDNLHDEAHLYTASKVQLGDREQTDGIMSHLMAGVSAALPFVIGGGLLMALGSLMVQFGAANVAPKAGQMASLAWVLNTVGGLGFTMMIPIMGAYIAYSIGDKPALAPAFLVTYLANTPAILGTQGGAGFLGAIVIGLSVGYFVKAFRKVKLGKTFQSTLGFLIIPFVTLLLFGLVTYYLLGPAMAWLMAALLSFLRSIPPEMKIAGGFLVGAMLAFDMGGPINKTAWFFGFSLLSSHVYTWYGIAGVVTVLPPMAAAIATWLKPGLFTKQERESSWPAMLVGMTVATEPAIPYALAAPVPMITANTLAGGIAGAVSMGLGVERLAPGLGVFDPLIGLSRPAWAYYIALAVGLVLNVLFVIVFKSAWLKRQERKNGILPLDDQSQSTIIDSGTTVSASSSQHAQTAKTVSPEAAKK

SEQ ID NO: 6305 - protein, 388 aa, Lactobacillus casei
LTKYDFDHVIDRHGTFSTQWDYIADRFGRNDILPFSISDTDFPVPAEVQEALEARFAHPIYGYTRWNHEAYKNSIVHWFEKDGHTKIDPDWIVYSPSVVFTIATLIRMNSQPGDAVAVFTPMYDAFYGTIEKNDRMLVPVRLRAADEGYQIDWDSLETVLAEEQTKIFLLTNPHNPTGRIFSKAELRRLYELCQSNHVFLISDDIHRDMVYLPHVYEPITNIGLKDVALCCSGSKTFNTPGLIGSYVFLPDPDLRTQFLIELKQKNALSSVSIFGMLAQIAAYNGSADYVEQLVAYTKKNLETVAAYLHENMPELKFSLPDATYLAWINVSGLGLSSDALQHRLVDIGHVGIMSGKTYGDARYLRMNIACPQEKLLDGLARLKKGIKG

SEQ ID NO: 6306 - protein, 574 aa, Lactobacillus casei
MLPLREVKILRLLSQQDFSGDELAKQLKASRRTIVRDIAAINDEIQKNRIGSITAQNKYHLTTLNPGKLTTLLNTSRDEANEILLRLCMQKTIAMGDLTSDMFLSRAQVTDYLTDLNSDYQDLLHISTRPGTGVTINMKRLTRIDLAADCLFEFPQLLAKVAPGIENTQRINTYLAQNACPYMTWVIDSQWRAQVISAFICRSSAKTYDSETAVTAGVNQFVQSREKLLAGLIAKHTSLMKSFSNMADKFQLEAIGQKTLESLFTHFGRECAFPRPLSTLSNYDITRLAAQNPVAFDFAQAVTDELLKADKQIWMDANFLALYIVQAINQREVKPVKILFLAPRMSLAQINATIIQQKLHNIVLDTVHSLTEAESAYAKGHFDLAIANVRNDVIEQSSIKFALTFSAVASEDDMTTLEQLVNGQYYHDNIAAMLAPNHFTNVAVTDKFLPALKKGLQIFSDAGLLAEEDLVKIVEREEAGNQLVLNHISIPHIVTASVSDYRLFAIKPEEKVTVENQEVYLMVIVLVGTSQAEKNTIFSYLYQTLRQYSTANIRQVQSYQQVIALLRGMGEFEG

SEQ ID NO: 6307 - protein, 509 aa, Lactobacillus casei
ABCHPERNREGLATRMNRKDNREYRLQLLLAQTTNFLTADELAARLDISKKTVYRLIKQVNETADDGTVIESAKGRGYRLNQERYILQKGPSRDDIEDISPADRQERVMEALLLASPKALKIRRLYSDFYVGDSTITNDEKVISKRLKKYGLNLTRKNRTLQITGSEPNIRKAIVEITQALNFVDIDDLKGTMKAGFNHYDMSLVLEQISTIEKILGEKVPYPYNVNLFSHLYILISRVKQGMIGCQNSVLTLEEKETMATEPRIAKIARQTIDNIGRYLHRHLPDVEQYYLFQYLVSSRLPDLSDRPSSFSKVVMDVANYYLHEVGHRLNLETSGTANFRDLASHVKPMLNRLKNDIRVKNVLLDQIKLSYQTIFDVVTEVSAELSEKYHLPQINADENGFITLYFARMSEVHQLPIQTLVMCTTGIGTSELLRAKIQKHFPELDIVDVVNTREYQQYLRKYPQTKLIITTVALRNKLPVRSLLVSAMLNSDDQARIQKVIEEIRNEK

SEQ ID NO: 6308 - protein, 151 aa, Lactobacillus casei
EIIAMKNDLISIFSNLALKDRADAYQFAANQIFPDDVLKAHRLVIDLLDRENLGSIQVADHVILPHVEGDFIPKTKLLIIKPQTNLRKWSPSIHDVQVMVFIFLKTDESKRTKLQIIDIMRKLGKEEFIQLLLRETDAGTLSELFWDSTQS

SEQ ID NO: 6309 - protein, 164 aa, Lactobacillus casei
EIIBCACMPNENTMKMDVVDIIDPRIVDPNVKARNKSEIVNKLAEDLFNYGYIDDVHAFVDDVYLRESEGQTGIGDYVAIPHSKSKHVQKIGVAIGISRNEIPWETLDGKGVKVVILFAVGNDQKAAKTHLKLLSLFAKKLGNEKVVHNLLRARDKDDVVNAFK

SEQ ID NO: 6310 - protein, 122 aa, Lactobacillus casei
EIIABCCMPNENTMKIVGVAACTVGIAHTYIAQEKLENAGKKAGAEIHIETQGTIGVENELTAKQIQDADLVILAIDVKISGEERFKGKRVIQVPTEIAIKSPNKLIAKAKEIIATASHAQA

SEQ ID NO: 6311 - protein, 378 aa, Lactobacillus casei
EIIBCCMPNENTMKALKSLNIKSNLLTAISYLIPIVCGAGFMIAIGMAFGGHAQDALIQGKFNFWDALATIGGKGLGMLPVVISTGIAFAIAAKPGIAPGFIIGLTANAISAGFIGGILGGFLAGYLVLGVLKFIKVPAWAKGLMPTLLIPFIASIIGGLVMVYIIGAPIAALTAMLTGFLKSLNSSSLLVFGAVIGLLSGVDYGGPINKTVFAFVLTLQAEGLNGPITALQLVNTATPIGFGLAFFVAKLFGKNIYTKVEVETLKSAVPMGVINIVEGVIPLVMNDIVRGVIATAIGGAAGGAVSMVMGADATVPFGGFLMIPTMSHPWAGVAGLLVNILVTAVTLALIKKNVSEEDLEKINEAEEEDIDLNDIKVI

SEQ ID NO: 6312 - protein, 217 aa, Lactobacillus casei
MKFFLDTADVKAIKQIEKLGLVDGVTTNPTIISREGRDFEEVIREIGQIVNGPISAEVTALDPKNMVEEAEKMAKWSDNVVIKLPMTESGLLATHYLSQEGIKTNVTLVFSVTQGLMAAKSGATFVSPFVGRLDDIAVNGMELVSKLRQIFDRYEFTTEIIAASIRNREHVEQAALSGAHIATIPPQLFKSLWYHPLTDQGVAQFTKDWEKFKQNRG

SEQ ID NO: 6313 - protein, 229 aa, Lactobacillus casei
MNQIQFSPSLMTMNLDKFKEEISYLNSKIDSFHIDIMDGHYVKNLSLSPWFIQEVRKISDLPLSAHLMVDEPDYWVDQLIKIKCDWICMHIEVLNGIAFRLIDQIHEAGLKAGVVLNPETPVDAIYPVIDKVDKVTIMTVDPGFAGQKFIGEALKKIVELRRLRGENGFQYLIEMDGSSNRQNFKKIAEAGPDIYIIGRSGLFGLSESIETSWELMQKDFQEMTGIKLL

SEQ ID NO: 6314 - protein, 149 aa, Lactobacillus casei
MLRELVTPEMVQLTDRKMDWKEAIRFAAQPLKNFGFIESRYIDAMIEKVEQYGAFIHIGKGIAMPHARPEDGALKVGISILKVANPVLLLGQKEHAVTFFICLSAIDDTTHLKALAELATFLSDEPSLNRLLAAKSKDEIISLLSGGGD

SEQ ID NO: 6315 - protein, 95 aa, Lactobacillus casei
IICBMKIAAVCGSGLGSSFMVEMNIQSVLKDLGVTGIETAHFDVGSATEGSADYFFVGKDLADSLSTLKNVIVLDSIIDKKELKTKVEALLKSQN

SEQ ID NO: 6316 - protein, 455 aa, Lactobacillus casei
MNGILKILIDIASTPAILVALIAILGLVLQRKHVSEVLKGGIKTFVGFLVLTAGANVVTGSLTPFGKMFQQAFHVTGVVPNNEAIIAIAIKNFGTATALIMLFGMAANILFARITKFKYIYLTGHAFFYQACIIAVILTTTRMNNVLMIIVGGIFLGMCGAIFPAIIQPFTKKITGTDDVALAHTGNFGYMIAGYIGKWFGNKKKSTEDINFPKGLSFLRDSTVSIALTMMVVYLIVAIFTGSTYIETKLSAGTNFIVFSLQQAGTFAAGVYVILAGVRMILAEIIPAFKGISERLVPNSKPGLDCPIVFPYAPNAVLIGFFSSFIGGIVSLIIMAMAGTTIVIPGVVPHFFCGATSAVYGNATGGIRGAVLGSFVQGIVISFMPLFLMPLVSNLGFTGSTFSDTDYGIIGLLLGQSSRMGGQIAVIGAVIMIGIVMFALTAIGKRKISKDEETA

SEQ ID NO: 6317 - protein, 285 aa, Lactobacillus casei
LNSNELSKLTRLAAKIRYGAIKSIQEAGQGHIGGSLSIADTLAVLYGKQMHINPQEPHWSNRDWLVLSKGHAGPALYSALAASGFIDDSVLATLNQGGTILPSHPDRNKTPGVDATTGSLGQGTSQAAGIATGLKQKHLSSYVYLIVGDGELNEGQCWEAFQYIASNKLNNCIVFIDNNKKQLDGWTDDIIRQFNIADKMRAFGFSTVTVDGRDIKQIDAAIDYLKTIEDSAVCIVLDTIKGAGVKLFEDMEDNHSVKFGNEKINKETDEALINLEQIFEGEKNV

SEQ ID NO: 6318 - protein, 337 aa, Lactobacillus casei
MFKLTEQRTKGKELRQTVVDTLNGLMEKDDRIIALDADLGGASNFLQFKQTHPDKFSDVGISEANMVGVAAGLSLTGFTPFIHTFAPFVARRALDQLFVSGAYSKNTINIFGSDPGFAAGFNGGTHTSYEDIGTLRTIPNIVICDAADEIQMSWVIKAFSQMKGIHYVRGNRKSVRSIYEAGSDFKLGKGNLIRNGSDYLIVAAGQLVSEALDVADILEEQGLTADVIDMFTIKPLDRDLLLKRMAYKKAVMTIENHNIIGGLGSAVAEVMAENRISIPLKRIGCNDRFGQVGTPEFLQEEYGLTTPKIYAQLKPFLEKSSGGRRESDLIAVKHIKN

SEQ ID NO: 6319 - protein, 158 aa, Lactobacillus casei
VQNLVLTRIDDRLIHGQVMTAWSRITHAEQVLVIDDAVAKDDFMINVLENAIPDTMAIGVFNKEDGVQFLSEPLEAPTIILAKVPETLEYLVDHGIDIKEIDLGGMGAKQGRERLYHTISTSPQENESFKRLIDKGVHVFIQIMPQNEKVELKDLLNK

SEQ ID NO: 6320 - protein, 154 aa, Lactobacillus casei
EIIABCMPNENTMINIVLLSHGPFCEGLLKSLEMIAGPQKNLHALQLHEGENPDNYRNQVDQLLSSLTGETMVFIDLKGGTPYNTAASLKQKYEFILISGMNIPILISVVTSRTETTTLEDLTQIALDPKNAGVELIKLTNGGNKRAKLSLNKN

SEQ ID NO: 6321 - protein, 560 aa, Lactobacillus casei
MLLSAILVALLAIISQWWFFAPITRCMTYPLTTGLLVGIFMGNPMLGMLAGANIQLVYLGWINAGGVMPSNTMVAGIYGSALTILSSANPKLAVTFAIPFSLLGLLMVQIYQTVNSFWVHRADKALSEGKVGQIRFLNYVPSFIVAFIVYGIPAFCLVMFGKSWTTSLISAIPAKFTTALEVVGGLMPALGIAMLLNYLGKKELNAFFIIGFFLTVYLKLDIMAIAIFSACIAFLVFISQSHSSKEAADATSPKKKVRRLTLQNRRGTAEEVTPTQNGASASEAATIQYTKKLTHSDLVKTWLWEQSDEAAYNYERLQALGLTNMMIHPIRKLYSKDRQADELKKYMVFFNTEPHMVGPIIHGVALSMEEARANGQNVSADDINSVRTGLMGPAAGIGDTVQQGIFFPILASVGASLALQGNYLGPVMFTVIFELVIYTIGYIMFMFGYRKGKESVISILKNGLIGKVTNAFSIVGLMVVGAMAASRVAVRTPLVWTVGKSTMKLQSILNQLAPGLIPLGITVLVWYLVRKKVNPTWIILGIFIAGILLSYLNVLGIVKA

SEQ ID NO: 6322 - protein, 236 aa, Lactobacillus casei
MKDFNVAIYADGASIEGMVEAKSKWPISGFTTNPTLMKRAGISDYMSFAKAALKAVEGLPISFEVFADDFPTMKKEAEKLAALSKNVFVKIPITNTKGESSAPLIKKLSAEGIQVNATAILTYEQVKEVADALSPKTHNIISVFAGRLADTGVDPIPLMRKSQDLVNQYPQASLLWASSRELLNIFQADNLGIDIITVTNAILEKMKMIGLDPKKLSLDTVQGFHKDVNALGFSIL

SEQ ID NO: 6323 - protein, 347 aa, Lactobacillus casei
MIVSNKKNVSIKDIAQLSGVSVATVSRIMNNSGRYSQKTRDKVLKIIRETGYERNSLATSLRINKSNMIGILVPDIANEFYASVLKKAEQALFKLGYSTIICNTERSVERETAYYRMLIEHRVDGLISVSSASNQMPLSAKYAIPIVFIDRDPHSASEMIVTTDHYAAGRDLTRLLLSQADDLCLVMTKSRPSSTMDRVQAFKDELSDRGISADGSILALNTTSDKFLQRHSDLENFIQIKHQEGRRLGVFAINDNVAYMVLQVAKRFHLSVPEDLIVTGFDGMSIASISQPTITTIVQDSTAIANQASQLLVDAIKKNNDNDVQHGTIHVPYQLAQRKSTLPEAKK

SEQ ID NO: 6324 - protein, 285 aa, Lactobacillus casei
VEINKILNNNVIVVKDDHGFEKVAMGKGIGFKRSAGEQLDPTVVDKFFSLQNDDMQSHFSALMAEVPYEILRVTEQFIDQAAKQLGQKLNASLHVSLVDHIYHALKRYEEGQLITNSLVYEIRNLYPKEFMLSKHFLEMVAAETNVHLPLDEAGFVAMHLINAEMNEEMGTTIAIMKEVYAMLNIIKYAFHGTYDEHSLNDYRLLTHLKFFVQRIIQDAMLQGNDLELYLLMKQKHPDAYQVSCKIANYVANTFGITLTTEEMLYLMIHLNRLQVRASEREDASP

SEQ ID NO: 6325 - protein, 634 aa, Lactobacillus casei
EIIBCACMPNENTMNDQQLAEQILVQVGGEHNVKSLVHCATRLRFKLKDRALANKEQIEALERVVTVMESAGQFQVVIGNTVSEVYQAFGKISGLIDEDRQEDTQDNANETIFGRFVDLISGLFTPLLGVMAGAGILKGLLAIATQLKWVMPNTSTYIILNAIGDSLFYFLPILLAITAARKFKGNPFVAVTIAGTLVYPTIITLADPGKSVDFFGIPLVMVKYTSTVIPIILAIYIASIFERYLNRYLPTSIKNFVTPAIVLVTVVPLTLMLFGPFGVYVGNALAAGLTAVFNINPIIAGALMGASWQILVIFGLHWGIVPVMLNNIATLGRDPIKPANAISVFSQAGATLGVMLRTKNKQFKALSASAVISALFGITEPAVYGVTLRLKRPFIIGVVSAAIGGGIVGFSGSAGYAAGPSSILMIPAFYGKNGEGFIGFLVAIAVTFITSTVLTYLIGFEDVPEKSGTSKKDTEPLNAKTQPSKAITISSPVTGKLCPLETIADKAFSSGALGQGVAVVPAKGEILSPVEGTVTVAFETGHAIGLMADDGPEILIHIGLDTVKLNGQYFELKVKQGQRVQVGDPLVHFDLDAIKAAGFDLTTPIIFTSIAPYQSMELSKQEQIGVGEHLATLV

SEQ ID NO: 6326 - protein, 500 aa, Lactobacillus casei
MQKTNVFPKDFLWGGAIAACQTEGAYLEDNSGLAVSDVSFFDPKLDRQDLAKHRRITSEIIETAMADTGTARYPKRHGVDFYHRYKEDIALCAEMGFKVFRFSIKWSRVFPTGEELAPNRAALDFYDRVLTEIEKHHMIPLVTISHFEMPLALVNRYNGWADRRVVDMFYRYADSLFARFGQRVPYWISFNEINAGRFSTFKSTGVVEDKSANYLQDCYQAVHHQFVAAAKITKRLREINPNAKMGCMIARFTTYAATSKPDDVLQMMLDEQHDNFFYTDVMVRGAYPHYMKRFFAENNVKIAWATEDEALLKKYTADYLAFSYYVSNVTSAAPEASATTEGNLRSSLKNPYLESSAWGWQIDPKGLRYTLNTFYDRYQVPLFIVENGLGAEDVPDEKGQVVDTYRIDYLQKHLEQVREALIDGVDLLGYTAWSSIDLVSSGTSEMSKRYGFVYVDQDDEGHGSLMRTRKASFYWYQQVIASNGEALSYSKQTHVALTEL

SEQ ID NO: 6327 - protein, 104 aa, Lactobacillus casei
MTKKTIMLVCAAGMSTSMLVKKMEDAAAKEGVDAKIFATSTADAHDKLDSENPDVLMLGPQVRYLENDFKKDLSIPVEVINMQDYGLMKGDKVLKAALDLIDKK

SEQ ID NO: 6328 - protein, 108 aa, Lactobacillus casei
MDEKQQLVVMQLIMAGGNAKGSAFEAIKAAKTGDFDTAEAKLREADKFLADAHNAQTGMLTDEAQGHHQPVSLLMVHGQDHVMNAITFRDLAGEIVDLYRKILEKPNS

SEQ ID NO: 6329 - protein, 164 aa, Lactobacillus casei
MPSPNKSKYDKGRRDLSLTSMYFNRYLLIRYTTAAFFFANLYWFVLSFSAVGFIKWWPLALLIITTAVAVEQASKYWRRDNKLPVTKIGYLVQLLSNFGSLVLVTTGFGPNVFPFFGPKGISLVTTILLIGMGLSFYILARVHLIETNKDRYLKQIHRFAQSLE

SEQ ID NO: 6330 - protein, 454 aa, Lactobacillus casei
MDSSNNKLFKFMNDHLMGPMGKLASFRIVRGVMAAGMASIPFTIVGSMFLIISVLPQSFPALAGIWKVSFDKIANLYMLANGATMGILALYFCLVFGYEYTRIQAQEEKIDINPLNGALLSMMAFFMCIPELVFKGGTATLVTEITKDSKIIDGYAIAGGVTRLGTTGIFTAIIMSIIAVKLYAWFVKKNIVVKMPDTVPEGVSRSFTALIPTAAIALTVIVINGVLMAFNTDIYKIVAIPFGFVTNLTSTWVGLLVVYFIMHALWIVGIHGATIVTSFLTPIVLSNMQLNQKGANIPFAGEFNNCFVTIGGSGATLGMVVFIAFFAKSAQLGALGKASLVPAFFNINEPILFGMPVVYNPYTAIPFFLAPMASMTIAYFAIDLHLVKPMIAQPAWPTPLGLSGFIGTAGDWRAIVLAFVCAFVAFLIWFPFIKFYDGKLYKDEQAKGAEEAAA

SEQ ID NO: 6331 - protein, 478 aa, Lactobacillus casei
LSAFPKGFLWGGAVAAHQFEGGWDSDGKGVSIADVMTAGDHQTSRRITDGVKPGENYPNHEAIDFYHRYKGDVELFSELGLNCFRTSIAWSRIFPNGDEDQPNEKGLKFYDDLFDDLLAHHIEPVITLSHFEMPYHLVQAYGGWRNRKLIDFFVRFAKVVFDRYKDKVKYWMTFNEINNQVGMLNEWSLFTNSGLVIQPSEDKEKVMFQAAHYEAVASALAVQVGHKINPDFQIGCMVAMGPVYPATPNPNDVFKAERLMQMNYYLADVQVKGRYPRFLENYFDRRKFDLDITLEDRDVLLAGKVDYIGFSYYASHVIKAQADEPKDFITLGNNQEVKNETLQRSDWGWEIDPVGLRYALNWFSDRYDVPLFIVENGLGAFDKVEKDGSIHDDYRIDYLRQHIEQMRLAVEVDGVNLMGYTPWGIIDLVSAGTGQMDKRYGVIYVDKDDQGKGSLARSKKDSFDWFRKVIQSNGEDLA

SEQ ID NO: 6332 - protein, 245 aa, Lactobacillus casei
LSQREKNYDTKELVNQLLKDIQQGVIQDAEGQLPTEPELMNQYHVTRYTLRQALKNLANLGYIYQAHGSGTFARPHHVEGAISLQNNVGLTEEMARQGKVVKTTHISQEVVPLAKADFIPENQKLDKATELISVIRQRKLDDEPFLVEHSYYLKSIVGEIPDRSLKGSLFAFINQKPGLKVGFIDSVIECEMISGLPARFFNVPDGSPSLVVRDDSYLSSGKLFAFSKIFYDFRKTKFFMLKKMR

SEQ ID NO: 6333 - protein, 280 aa, Lactobacillus casei
MAKLVLQTDFGLVDGAVAAMYGVAYGVDGDLSIHDLTHEIPPYDIFAASYRLYQTTKYWPEGTVFVSVVDPGVGSDRRSIIAETTDHHFIITPDNGTLTHLAKFVGLKRVSVIDEASHALPGSQESHTFHGRDVYAYNGAKLASGQISFEDLGQPISPDEVVMLPLGEVTEGDNQIAGTIDILDIRFGSLWTNIPLDTFKKLGVEPGELVQVSIYYRDQMRYQNQMPFTRTFAAVRVGEPLVYVNSLLNLGVAINQDSFSKLYHIGTGVDWHITVKRLSV

SEQ ID NO: 6334 - protein, 186 aa, Lactobacillus casei
MRDHKVLSVRTVVAIGIGTAILFILKRFAVIPTGIANTNIDISYGFLGFIATLFGPVAGFFIGFLGHALNDFTQYGQPWWTWVFTTGLVGMVIGLFWKRFNIEAGNFGMKKIVAFNVLQVITNVVSWSLIAPTLDIIIYSEPANKVYVQGIVSAISNSIATGVIGTILLVAYAATRTRSGSLKKES

SEQ ID NO: 6335 - protein, 566 aa, Lactobacillus casei
MTVPAIQLEHVTFQYDSQAEPTLHDVNLTIQPGEKVLIVGPSGSGKSTLGNLINGLIPHAFPGKLSGTVKVNGAVVQDQSLAALSVNVGTVLQDPDAQFVALTAGEDIAFALENSAVAPSEMHTRVKKWADRLKIGDLLAQAPQSLSGGQKQRVAMAGVLIDEGDVLLFDEPLASLDPATGEASVALIDELHQAYHVTEVIIEHRLEDVLRRPIDRLVVMADGRILADDTPENLLRGQLLQKIGLREPLYLEAAEFAGIDLKQASHLADLETFDAPELGAKLATFTEDAPTVVAEEPQAPLLTVDALQFAYPKGRQIFTDLNLTLHHGEMVALVGRNGVGKSTLSHLIAGFLTPSAGKITLDGEDLADWSVKERADKIGYILQDPNQMISKHLIFDEVALGPRLRGWDEARVKDAVLAALKVCGLYPFRSWPINALSYGQKKRVTIAAILVLEPALMILDEPTAGQDWRHFTDMMRFLTKLNAQGITMMLITHDMHLMLEYAQRAIVLGDGGVLMDATPATVLTNPAVIEHASLAQPSLYRLAKRLGLDPLAFTQAVIDQERRVRQ

SEQ ID NO: 6336 - protein, 275 aa, Lactobacillus casei
MNSLFGYDPQDTWLHRLTGATKMLAFLGISVIVMASYDTRFVCAVMLASIILFAQAKIRWHQISLVVKIITIFAVVNLLLVFVFSPQYGVGLYGSKHVLLHAGYFTITQEQLFYELNLALKYIVTVPLALIFLITTNPSEFAASLNKLHVSYRISYSVALALRYIPDVQANFRQISLAQQARGYELSRKAKLFQRLKGMGQILMPLIFTSLDRIDQISQAMELRRFGTGKRRTWYMDQPLRTPDWLVLVGVVVIILVGLVLFHVNGGRFYNPFRG

SEQ ID NO: 6337 - protein, 259 aa, Lactobacillus casei
MNNFNTPKGRIVFEHEREDLAKVVQVVMERDDTNIAGGNISFKVTDNNTGKEYIIMTPTMMSEAYLGHLTPEQILVVEPHTRKIIAGEGNLTREINMHEAVYDANPDIRCVFHSHAKNAMFWATSGLNMPNITEATQKVGFIETLPFEPNCSEPLAELVAQNIAKIGDKAIPHMYLLNSHGVLITTGGKGVDGLTALHSALAIVDTVEWNADIAFKQTLMQKLGLLDGYYSKGTKIGTLEDMEEGKPIYNRAKAAVSGD

SEQ ID NO: 6338 - protein, 87 aa, Lactobacillus casei
MLEKKRKVMKMFWTFASFVAFGIFVIAITTKIYWLNVFVIILGLLIKNKGYTTLFSENEKRRADIKADLIKSHVIKQANHTKKEINL

SEQ ID NO: 6339 - protein, 461 aa, Lactobacillus casei
MNWNNIVQAILSPGPQVVVSALIMVLGFAFGMKASKAILSGLYLGVGFVGMTMAINALVAAVSPAAKALATNTGINLPTVDFGWTGAAAITWAWPLAFIFFAVEIGVNLVMLLTKTTNVINADMWNIWGVALTGYMVYSTTSSYVWAFIAGAIQVVVMLKLGDMWSEEIHDMLGYPGVTTTHIEAFTAVLMAPVNKLMDYIPVFNRRWDAKALKKKIGIISEPVVMGFIIGLILALAGRYSIGKALNLAVTTGAIMAIFPVMAKFFMDSLTPFGTTMSNFMKKRFKNREFVIGLDWPILGQSTELWVTMVILIPISILYAAVLPGNTILPFAGVINYCLGVGGLLLTGGNLLRMVVLGIIYEPLFLYGGTFFANEFTALAKSTQAINVPKGSTVSWSSIEAPDLRFLMAQGFKGNWLALLGLALLMALFWIVYRSFKKNPNPAKKYTDSASKAAAPITAKE

SEQ ID NO: 6340 - protein, 109 aa, Lactobacillus casei
MKTILVCCGSGVATSPQVANKINDFLEEQGLDGLAHAEPHPVETAKSRIDSNPDIIAYVGIAPADDDLRETIEANHVTEVVGVPWLTGMGEDEANEKIKQAVLGSTQHN

SEQ ID NO: 6341 - protein, 157 aa, Lactobacillus casei
LYESMFSKELIDLNNPSTSSRELFDSVASVAHDKGYARKDYGKGLIDREAKFPTGLMFPSLKIALPHVDPEFVLKPFIYVVKTNTPIGWKQMGDMKPMSTSNFLFLGIKEPSKQVGLLAQIMSAFKDQEFVKEFLKTTDETKMYHLLSEQFTKISVN

SEQ ID NO: 6342 - protein, 259 aa, Lactobacillus casei
MMKAQRQSAILALLNSAEGKSLTTTEIAKSMNVASMTIRRDLNEMAQEKLINRVYGGASLINEKSTKEKTQVQRESKIEIGRVIGSLIHPKATIFLGAGTTIYAAADFLPKKDDVKYITNSDLIFRYLVNKDINVFLTGGFYHKITNEFVGSIAEQTLSNFIFDLAFISTNGVFDDQVTTANFDEGNIQKAAMKRSKKMYVVADHTKFGRGDSFSFAQLEEFTGLITDSRISQSDLKHYREITGVLVGKADSNAIDNNN

SEQ ID NO: 6343 - protein, 329 aa, Lactobacillus casei
MLLTITTNPSIDVVYQTNFFKLGQTNREVSHYQVIGGKGINAGRVASILTGNKENVAAMGFVGRDNSAGIIQDLQEYGVVNKMIQVPGKTRFCYTIIDGKGQKTELNEVGQQISTEEANQLLEQISSLTNLNGVSINGSLAPNLPENFYSQVIRTVREKNPRAKIVLDTSGAALKSVLMGKDLPDYIKPNSEELSELLATDVVEEKNAVLSALMNPIFKNIPNVLVSMGAHGGVAKVGIETPRYYKIKISSQLAVNPEGSGDAMIGGILSALAYGKSNIDVIRAAMAAGMANAVEAKTGFVQKSTFNRFLRSDKDIHVQIIKAVPTPIK

SEQ ID NO: 6344 - protein, 993 aa, Lactobacillus casei
MTTAKLWEQPELTDINRMVPRSHFETFFPGEYKQPRHYQLLNGTWQFKFLDAPEYAPADFMASDFNDHDWDQIPVPSNWQLQGYGKMHYSDLWYNFPIDPPFVPRENPTGLYRRTFTVDEIAASEQYIIGFNGVDSAFKLYLNGEFIGYSKGARLPGEFDVTKALKQGTNTIAVEVVQWSDGTYLEDQDMWWLSGLFRDVSLYSRPQNGLYDVRIRTYLSNAYRTGELVVTPTLTGSSVSSEIHYELTKDGATLVDQTLPADVSLDATIDNIQAWSAEAPHLYDLTMTVLQDDQPLEVVRQRVGFRQIELDGKTFLVNGQAIKFKGVNMHDYSATKGRVMSEADLKKNIILMKRHNINAIRTSHYPKAPYFYDLCDELGMYVIDETDLECHGFELTERYDWITDDPRWKTAYVDRMRRTLQRDKNHPSIIMWSLGNESAFGDNFRAMAAYCKAEDPTRLVHYEGDFEAEVSDVYSTMYTWLEHDTKMTMADVLQKTQKPHILCEYAHSMGNGPGNLKEYQDLFYGHKQLQGGFIWEWFDQGVATKEGDQTYYRYGGDFGDQPNNGNFCIDGLIRPDGNPSTALTEVKKTFEPFQIAVRDLATQTITITNRLDFLSSDQFSFAYELEADGQTVAKGKLDLPTIQPGTAKTVKLGIQLPKFNAETIYNLHLLTELKEATAWADAGTVLSQSVINLQRPKFQVAHQQTTALQATEDNTTITVTGGDYEYRFDKIKGTFSLSHAGSDLIRDGIKMNFWRAPIDNDMYLLDDYYNKYFLNLWHESTREVHLQPQTNGNYVVSLTKQVGTTNSGWYYMIQQQYTIHQDGSFDLDVVGKASGKRDMAPEMLPRIGVKMTLPKAYQQVSYDGLGPTENYRDSHQAAYYSHFTSSVDDLFVNYVKPQENGNHMDTDRLALTDGQHHLTLTMTKPLNFSVSNYADETLEAAKHTIDLKQSDRLNLYLDFRQNGLGTNSCGQDQLKRYRCKFDDFELGFNFKAN

SEQ ID NO: 6345 - protein, 493 aa, Lactobacillus casei
MSEDKSRQRLGSAALMLMTFSAVFAFPSIVNNSIQIGLATIPGYIFGSLFYFLPFILMIAEFASANSDKESGVHSWLESVLGSKFAFLGAWSYFFVNLFFFVSLLPNTLIYGSYALLGHNVFGGAMGTKIISILSIVLFWLATWVCIKGVSWISTVTNFAGTARLLMGVIFVVLAFVVVMGMGEKPAQDFSMKAITPTFNWTFFMTMAWILQAVGGGESIGVYIKDTKGGNKTFVRTMIISTLIVGLMYVLGAIAVGFVVPKSVLAGNFSNGIFDIFKILGTHFNIPGNVMVRLVGLILFIGSLGSLALWTAAPVKVFFSEIPEGVFGKWMVKTNQEGNPTNALIVQGFVVTLLMIVPALGIGNLDSFLETLINMTAATSLLPVLFLLIAYIMLRWKKDDMPRDFRFGNRTVGLIAGIFLLCVFLFVFFMSTVPDPHLIAEELAGHLPKGTASPIGTLLYNVLGVVIFMGVAWIYWDRYEKRERLAKAEPVSH

SEQ ID NO: 6346 - protein, 484 aa, Lactobacillus casei
LAQMIASTQVKRVLKTRHLSMIALGGSIGTGLFVASGCAIATAGPGGAIVAYIAIGLMVFFLMTSLGEMATYSPVSGSFSEYASRFVDPALGFALGWNYWLNWAITLAVDVSTTAIVMHFWLPNLPGWGISVGFLALIFVINFVSAKSFAETEYWLSLVKVVTVIVFLGVGVLTIVGIMGSDGAVGLGNYTTGAAPFVGGLPATLSVFVVAGFSFQGTELIGITAGESETPETSIPKAIKQVFWRILLFYILSIAIIAAIIPYTSPNLLGSSVNDVAISPFTLVFNRIGMAGAASIMNAVILTSVLSSANSGMYASTRMLWAMAGSGFAPRIFKKTNRRGVPIAALLLTTLVGGMTFLTSIMGPEVYQLLVAASGLTGFLAWLGIAISHLRFRRAFIKQGHSLNELAYHAKWFPVGPVLAMVMSLIVIIGQDIGSLTSFAWRRLLISYMSIPLFIGLFVYYKVKNKTKLIPLDQIDLTRRRERR

SEQ ID NO: 6347 - protein, 771 aa, Lactobacillus casei
MKKLIKYVVVGCASLILCFCGIMLTRGTVVHADTINDYPNLLNVGGNPTKHIYSANKDVSTNKYSHFSDLGAWHGYYQPIKRVASTLGGFPGPMIIAEEYPVNLSHQLSQLNLVNRKTGKKYSFKNAKATFTSYPGRLNQIYTFKDLEVTLNLIFTSNRTALIQTTLKNRTEQSLDLKCAWTGDIINKLRAGEKDISLKQHLVATNDGVQVAFQKVRNDNYYMTTDQNKVTVAYSRPVTTTITGNQYKSSMKDSISLAAKGTTDLYTVESYVFNAAEQAKETANYQDYFTNAKQYFEKNAARWNNYLNKAVSSDQKNVKKKEKRDRVAIKSVETLINNWMSPAGALKHDGIVPSMSDQWFVGLWAWDSWKEASAVAEIDPTLAENTIRALFDYQIQTSDKVRPQDSGMIPDAIFYNKNKERGGDGINWNERNSKPPLAAWAVWQVYQQNHDKQFLAEMYPKLVAYHNWWYTNRDFNKNGLAEYGATVDPLHFKKVKGKKEPDTKAIILASAWESGMDNAVRFDAKGVGKADKGVKIREDKNSDGKVVGYSINQESVDLNAYLYAEKGYLTLMAKVLEKQDDVTKYTTEAANLKKVINQDFYDQKTGFYYDRQVNGKQSMLLSNRGKGTEGWIPLWANLATTSHAKGVEKVMMNKKMFNTYMPLPTTSRDNKKFTATKYWRGPVWLDQAMFGVEGLQNYGYTKDALALTDKLFDHAQGLNGTGPIRENYNPLNGNGLNSMNFSWSSSVYYMLHHNIYGTEETSSQTAFNRRP

SEQ ID NO: 6348 - protein, 284 aa, Lactobacillus casei
MFKENKWLRTDQFVCPELSVFEVGYEDVHPRAPYQYEQLDYYLLHFILQGEGLFFINNEIHQLSRGQGFLIPPFTDNNYYPLIGNPWSYRWIGVRGTGAEAVFRAAGLGKTNFVYRHQDVHQMDRLFGEAYDYFSGDHLYGALGKFYEIVSALVEDYQQETRLGVLPTQQYVLQAVEILKNEYADNTLRIDDVAARVKVERTYLYRIFMSNLGVSPKSYLMQLRINQAIELLRNTNDAIGDIAIKVGFTSYPQFAKAFMKARSMSPSAFRKAISSGELSPRKID

SEQ ID NO: 6349 - protein, 182 aa, Lactobacillus casei
MAVAQKGFSLFLEHQAVVYGALAKLGIRPHHSDFQDWRDEGMLVYLNYFSRYRDPLTDEAAITKFNKLAWRFVFLTLMQRMQKVRHRRELEEAPANAAVLQTTTVATSPASLEQSVELKQLLRQLEAILTPVERRVLQLRLAGLPDTGIAGELQVSRQRVLKVRKQIQAKYRQLELEEFLNG

SEQ ID NO: 6350 - protein, 50 aa, Lactobacillus casei
MDKELLTYVLDQAVGVVIAVILLTRIERRLDTLITNMGTFMVKLEGKHER

SEQ ID NO: 6351 - protein, 254 aa, Lactobacillus casei
MAILMADVSSWQPDSESWFRKLADFGVKAVVVKLTEGTTYQNPKAVAQLAAGRKVGMQVHAYHYAHYRNSAEAVAEGRFFGLAARALGVSTQSVMAADVEAPELTGDLTGLTNVFIQTVKSLGYPHTDLYTMANWMKTGRFDRVALIPKNLWIASYGVDQPGIDNVGTWQFTNNFHGLGVDMSYDFFGHYTTRLSGELNGGVVRAPTVRYHSVQAGESWWAIAHRYGLNMDNLAALNGKTIYSVIHPGDQLRLN

SEQ ID NO: 6352 - protein, 168 aa, Lactobacillus casei
MVLSTFEHLDENKQQRILAALVTEFSKYPLAQAQVARIVKQADIARGAFYKYFSDLKDAYQYAFKEVIGRLHTGIAGPEMRRDPYAATVAFLQEADESQDRDFIRQHFTKNSGMVSVGEPPIAANAIEWAVTTLCHSAISQALANPEQADLILKNLKAALLQLHVKES

SEQ ID NO: 6353 - protein, 353 aa, Lactobacillus casei
MYLSLKEIWHEKLRYGLIVAMMLLVTYLVFILSALANGLSQQNTQAINSWDTSRVVLAKDSDINLSQSLLTSQQTKDLNLGKSQAYVGTIGVVATSSKHDEIRSTMIGLDWDQYIGKDMKLVSGHRAKGDHQIVVDTEFKDKGYALGDKVKLSTKGKRYTIVGFTENAKMSVAPVVYGTMNAWRTLHNLPNTFTASGIVSKSNNFQVNTSDLKTYSANTFIQKLPGYSAQNSTFTFMIGFLFVISLIVIAVFLYILTMQKLPNYAVLRAQGVPSRTLVITTIAQALILVTLGLALGGALTAVTAQFMPMGVPMIFSPQLNVAIVIGILLTGFLGSIIPIRTILKVDPVTAIGG

SEQ ID NO: 6354 - protein, 229 aa, Lactobacillus casei
MSAIELKHIIKNFKTPTSNVEVLKDVNFSADSGSLSLVLGPSGSGKSTFLTIAGGIQTPTEGVVTTAGKNLEQLSGKARDALRLDNIGFVLQSYNLVPYLTVGEQFKLVDKIKPKGNLSHEALEALLDDLGIANLVNQYPASLSGGQTQRVAIARALYPDPAIVLADEPTAALDSPRVAIVGQLLADLAHKHNKAIVVVTHDVRLEQFADRKFTLLDGQLKEGAPKYAA

SEQ ID NO: 6355 - protein, 481 aa, Lactobacillus casei
  misc_feature (8)..(8): Xaa can be any naturally occurring amino acid
NADHPERXIDASELKAVTTYEEEFIVDKPKIIVVGASHGGHQSVLELLHRYPDADITMFEAGDFVSFMSCGMELFLEDQVTDVNDVRNFRPDDLIKRGAHVLNNHEVTAINADVKTVTVRDTKNGTAQDYPYDKLILSSGVRPNSLPVPGNDLKNIFLMRGYDWATKIKAKLEDPAVKHITIIGAGYIGIEAAEASRKAGKEVTLLDIIDRPLGTYLDPDMTDIIAKELTDKGVELKLGVKIESFAGDGAVSAVKTDAGDVATDLVIQAAGVKPATEWLKGTVDLDDRGFINTDPYLRTNLPDVYAIGDATLVYGVAAQQKVPIALATVARREARYLAANIFAEHPARPFGGVVGSSALSVFDYHFAATGLNTFTAGRSGVKVDTSFYTDTLRPAYVPEGNGNPPVCVNLVFDPQTHRLLGGAVLSTYDVTAQGNVLALAVQHGLSLEDLAEADFFFQPGFDRQWSLLNLAAQHALGEPRF

SEQ ID NO: 6356 - protein, 272 aa, Lactobacillus casei
MFRLIAVDLDDTLLDSHKQLSSATIRGLKAAQAKGIKIVPCTGRPLPGVRTTLDALGLHGDDQYVIVQGGGVVQSTNGKIIAQKFLNHQDYQDFSTFATHVSAAEIDSNVITPAGDVYTADRNISKYTVLQAWENHAGIKVREPQEMPNDFVIAKGLLLGEPENLAKIQPQAEAEFGNRFTVIRSMPFMLEIMPRGVNKGWGLAQLTQYLGLHPDDVIAFGDEHNDLDMFDFAGTSVAVANGRDVVKDQADYVTASNDEDGVVQALKHFKII

SEQ ID NO: 6357 - protein, 89 aa, Lactobacillus casei
MPTRQIIEQSRFKKHLKHLLQAGRFTQADYQQVLDYLRSGQPLPEKYDDHVIKKRKTDRALFIKGNWLLIYRLETDVVRLLDVGRHGEV

SEQ ID NO: 6358 - protein, 335 aa, Lactobacillus casei
MATISEVAKLAGVSVSTVSRIINHRPHVSPRKAALVADAMKKLGYQPLQAARQMRGSGSQTIAVTVPYITNPFFSELVAAIERTADERSYKTVIVQTFGQKSHERNALDFLKTNQVDAVIMCAIENDWDLIKQYRQYGIIAVCNEYVADDDTLMVHADQESGMYAGTKYLLNQGYRNLAFCTGQKAIRYEAEAEDLNSDRYRGYLRALREFDLEPSVEWQFTDINTIADGQNVLQRLMAMKQQPDAVIAGSDQVAAGIIAEAQVMGLKVPEDLAVMGFDDQPLSQVVARPLTTIHQPVHEIGDQIANMVANELEGKSISDKRVVLPLSVVVRQSA

SEQ ID NO: 6359 - protein, 163 aa, Lactobacillus casei
MTVVLARVDQRLVHGIVVNQWAAEVQPKRYMVIDDVVSQDENVKASMRLSKPAGTGMSIINTEKALTNFKAGKYDAQRVFVIAKEPSTMLKLLDAGIEIPRVDIGIIFAEDGRTQISKFVSVNQQEVADFKELEKRGVPVNIRYVPADAPVPFDRALEGKTIQ

SEQ ID NO: 6360 - protein, 268 aa, Lactobacillus casei
MPHILQDILIILLASYATLDNQGITIMNYWPVTVGLFAGLIMGDLPTAMTIAGTFQLMSLGVAGLGGASVPDYGLATIVGIYLSARTGAGLGTAVAVGLPVGLLTIQLDVVIKIINNFIAHKAQAYAHAKEFSKMRMINWLGPLFFALKNFIPMILIVTVGPSAISALLKVIPKWLTNGLTIAGSMLPVVGIGMLMHYMPLKKYIWVLMIGFVMSAYLKVPILGVAIIGLALGIYTYQNLINASKKKEVAAVNGADAAEDDEGDDYDE

SEQ ID NO: 6361 - protein, 273 aa, Lactobacillus casei
MSDVQPKLTKKERHSAILRYMAMGVNNFNYETQQGPSVVWAFSKVLRKIYPDDDDYVAALDNHFKYFNTTTAMAGMILGATLAMEERDGIKSKDAVQALKTSLMGPFAGVGDTIIWILLPTIMGSIAGYMALQGNPLGAIIWILVDILLFWARIKLFDIGYDSGVKLVTTMANQLSAFTEAASVMGITVVGTLIATVVKVYTPLQFQFGKVKLAMQTGILDKIMPALLPALVAWMVYKLLGSKKWTPNRVIILILAIALVGSFFGILGVQPTK

SEQ ID NO: 6362 - protein, 749 aa, Lactobacillus casei
LNQKNQIKGDHFRFTVLTNKMIRMEYQPEGKFEDATTQTVTNRDLGQSEFRVEHNKDGFVVQIETDSFHLYYRGGEFNGENLFIDTKYNYQTHYPRWHYGDDDPKNLLGTARTLDGADGAIPLKPGIMSRSGFAILDDSQSMLQSGDTVSQRSASEIDLYGFAYGHDYRAALRDYYRLTGFPPLVPRFALGNWWSRFYPYTQKSYLDLMAHFKKAGVPISVAVLDMNWHVTDIPAQYGSGWTGYTWNKKLFPEPAKFLQTLHEQGKHVTLNVHPAAGIRPSEAKYGQVAKAVGIDPASKQPVLFDLNNRNFVRAYFDLVHHPLEREGVDFWWLDWQQGAARSQKQIDPLWALNVLHFEDQQRKKGDQALILSRYAGPGSHRYPIGFSGDTVASWQSLKFQPYFTVTATNIGYTWWSHDIGGHMHGHYDPELSLRWLQFGVFSPIMRLHSSDNPFMGKEPWNYDEVTAEIMTQFMRLRAQLVPYLFTADILTHQQGQALIEPIYYHDSEVKEAYQFKNEYFFGSEMLVVPITSPSDQETGLASATGYVPAGDWTDFFTHQMYHGPAIVKFHREASHYPVLVRSGGIIPLALDPMASTDTLPNAMTIKLFPGERHAYVLREQTSSGEAQTKFTWDPQANIFAIKVADPDGVIPAKRTYRLDVVGSAEKIKPVNGHHNQEMSLAMKSQNHETEKMAQIFTVLQQAKVDFDLKKQLWQSIQNMPTIKTALTVTSLAPKNLSDALLEILLNDHA

SEQ ID NO: 6363 - protein, 138 aa, Lactobacillus casei
MERTIVLASHHRLAEGLKDTLNFISGGGQDIVSMAAYLDNQPVENQVDALMASFPADRDVIVLTDMMAGSVNQKFFKYRTRPHTHIISGMNLPLALGIAMAPTNEYVSDDQINDLIQEAKNAIVNVNTLQVEADDDDE

SEQ ID NO: 6364 - protein, 564 aa, Lactobacillus casei
MMNKVPWWKKSVVYQVYPKSFNDSNGDGIGDLNGITAKLDYLADLGVDVLWLNPIYQSPQIDNGYDISNYRAIEPQLGTMGDFERLLKAAHTRHLKIILDLVVNHTSDLHPWFQAAKSSKNDSHHDFYIWKKPVDGHEPNNWGSSFGGSAWTYEKDLGEYYLHLFAKQQPDLNWENPRVRQEVYDLMQFWLDKGVDGFRMDVISLISKDPAYLDGPLIQGKAYGSYYAGAANGPKVHKYLQEMHKRVLSSKDIMTVGETPHTTAKQAQLYTAADRHELDMVFHFDHMHLDYGQYGKFSTNRFKLTDLKAVLARWQTTLAQVNGWNSLYWSNHDQPRPVTRFGDEGQYRVRSAKMLGTVLHMLQGTPYIFEGEELGLKNVHFKQLSDYNDLETKNIFKELTQLHHESEQEAMQAIYLHSRDNARTPMPWDASEQGGFTTGKAWLKLNPDHQEINAAKDLADSDGVYHYYQRLIKLRHGEPLVTSGVFELLDPEDPNLFVYLRKGEKETLLVAGNFSAKTQKWQTPESLQQQAATILICNANFSKQLGSTLTLPPFGTVVYKLKQS

SEQ ID NO: 6365 - protein, 107 aa, Lactobacillus casei
MAVDEKQALIAKMLKLQHLFEPQADEISQEIVVKIKQVVDRLAKKRIQGANIEPEVHPVSIFIRDQMLDHHYQITTEQRDALFDMEEAAQEIAKKFFISFPGISGPL

SEQ ID NO: 6366 - protein, 262 aa, Lactobacillus casei
VSKGMISKFENGTSDLSTKRFFHLLKKLYITPFEFTVVMNHFEPLYDNKFATNLTQSALNNDFAGLKRLADSEYARWQNSHSIFDQLNWIMAECVRAEAEKKPLSDKVHLNVLTNYLFQCEDWGNFELVLYGNTMTQLPIETITVFSQTLLDKCSIYIGLTSVYETCINVLLNTVALLIRHGKTQHALKTLAILEQKKLPESFLLERVLLNYYKGILLTQTGRRAEGDQLIDSSLQALKAGDCVEFVNSLKKDLAKLGLYHI

SEQ ID NO: 6367 - protein, 530 aa, Lactobacillus casei
MKSYLKHEHGRTGINIIWIVVNVLLYTGTSVLLTFTTNAIFSRDMRALLVWSAINFSVWGAFLISNYFQVVFQEKLTQRIMVDIRDTISRKIVGSSYAQYHNKTTGEYLSEYVNDVGNIESNAIKKFFTLLSDGTTVVFSTIALAAYHLLFIPAILLLSVLMLRVPSRLSRPMTSATKTMSKGNAAFSNQVTNVLNGFDVLFNANKLGKLHDLIKSAAKKYAAVKVAYTKTNARVSNLIAALSIFCQVMVDIMTSILAILGAIPLGAISSTGSIAANIFNSLSSLSNDTVQIKATYPLFDKVSAGASKKLPSAEKTPVPVFHHALRVVDLSYAIDGKQILNHLNLTFERGGKYAIIGRSGVGKSTLLKILDGQITDYTGHVYIDNKDLRAMSMAELTKVSQYVDQNVYLFNDSVANNTSLWENQSRSKHRLQEAFSKAKVDFVEFPGQIIQENGQNLSGGQKQRLALARFFYAPKPIAFVDEGTSALDAKTARLVTEEFLKDPDMTLIEVSHHLDHELRGAYDQVIDLGA

SEQ ID NO: 6368 - protein, 603 aa, Lactobacillus casei
LINIGGRRGPRNLHPEKVTLVNWKQTVRRIWGYLNADRSKLLIVFGLTLFTTLATIIGNRVNGIVVDQFITKGRLRELLIVSGLLAGMYFLSSVFTYFQTSITTKVAQSTSAAIRHDLFAKMQRLPMRYFDTHDNGDIMSRLTNDVDNINTALMQTFVQLYTGIISVIGMGIAMLLLSPLLTGIVVLASVATFFYSRAAARITQRAFTVQQEALGSLNTQIEENVAGKQLVQLFDHQQDTLDRFNETNARYTAAAYRAQLFSGVIGPFNNMTNNFAYLLITFAGALAILHGGTSITVGVIFTFLIYLRNFTGPINNILNLINTLQLSLASAERVFQVVDAEPEKDLPNALTLTHTAGNVQFDHVSFAYDGKTEVLHDISFTAHQGEVVAIVGPTGAGKTTIMNLLTNLYPLTSGSITLDGHNVTDLTRANLRRLVTVVQQESFLFTATIRENIRMGRPEATDVEVETAAQAANADTFIRQLPDGYDTLLSENASRLSQGQRQLLSIARAFVAQAPVLVLDEATASIDSNTETDVQRAMNRLMQQRTSFVIAHRLSTIRHASKILVIDQGRLIESGTHEQLLAAGGFYAKLYNSPLADMDKLKR

SEQ ID NO: 6369 - protein, 569 aa, Lactobacillus casei
MLKILFDHMHGWARVSFFLAPIAIMGEALLDLQQPTLMARIVDVGLARKDMTYVWQTAILMAVIAVAAFALGAICNAFSSYAALKMGQNLRSHMLAIALADRDPQALKPETLITRITNDVTQMQTMVSMLTRGLIRSPMLLFGGIVMSMIVSPRLSWIVLIALPILAIYIYVVVRRSLPLYTAMQGQVDVMNRIMSENLTGAKTIKAYVLEDHQRTQFNTENHNLQQISQRAVLATVTLAPLIMLVLNLAVVAALAYGGNLAIAGSMTTGEIMAFVNYMIQITTAMTNTVNLITTFSRAVTSSARVSAVLAEEAGTEATGTLAAPADSTIAFNHVTFGFSKSRPILDDINLTVPSGQWLGIIGSTGSGKTTLIELLTRLYEHYQGSITIGGTDIQQISLASLHKKITVALQNSLLFSGTVERNLDYGAPQATPAQLASGVAIASATEFIGTDYTAPVEEAGKNFSGGQRQRLNLARAIIPDPDILVMDDATSAVDQETNTAIQDALVKNRRNRSTIIISQRVPNIMDCDQIIVMQNGRITARGTHDELVKSSPFYAQLVQTQLGGEYLD

SEQ ID NO: 6370 - protein, 68 aa, Lactobacillus casei
MVLGLSNHIPTKGGASLSSVIDAFAAITAGLGSAIVMVNVFTRLIKALEKLCDAVYELKQALGKFREK

SEQ ID NO: 6371 - protein, 94 aa, Lactobacillus casei
LKHKTLRVITGIFSTGLLLLILVFLTYRVHRNGSRIGTLQSYLALMVIMGVTLLLMMVADRTFLLITGRHLTKMFVELRDAIDELKEALRRLRE

SEQ ID NO: 6372 - protein, 202 aa, Lactobacillus casei
MKKVVVIGAFGTIGSQVAQLLRKYGYDVITASRHQGDVRVDIADLSSIEAMFAKIGSIDAIINVAGAVKVMPLDTMTPADNMVAVTSKLLGQINLVLVGQHHLNDNGSITLTTGVTKDDPIAGGASGAMANGGVAAFVKSAAIDLKRGLRINCVSPTIVEESYDQLKDSYAGFIPIPAKLAATGYLKSVQGKQTGQEYRIYH

SEQ ID NO: 6373 - protein, 189 aa, Lactobacillus casei
MTKPLSELTLEELWQLFPISLTEPQKQWATDYEQESSRIRKILQNVAVVRISHIGSTAIKNIWAKSIVDILVEVSPKTNLVDVAEQLSRNGYIIMSDEKERISLNKGYTVHGFAKSVYHLHLRFAGDNDELYFRDYLNNHPEVAKKYETLKIKLWHQFEHNRDAYTKAKGEFIQKYTKLAKTKYQGRYV

SEQ ID NO: 6374 - protein, 546 aa, Lactobacillus casei
MLKRLAKIASAFSITLLLAGCGQQSSSKTSGNNTYKTMTSDIIATMDPAQFTDAVSGQTLTDTMAGLYRYKGKKLTSDLAVKTDVSSDQKTYTFHLRHGSKWSDGTDVTAPDFVFAWQRVVDPATKSPYAFIMSGIKNADAITAGKMAASQLGVKAPDKYTFVVSLDQPIPYFKSMTCLQTFDPVEKKAVEKYGKNFAKTSAQLTFNGPFILKNWKGTDDSWVEVKNPNYWNAKNVHLKKITYQAVKENSTAMNLYKSGKLDDVSVTGQTAEAAKGQSGYHVIKQPWETYLRMNSQAVPAFGNTKVRQALSMAINRKAFISKVLGDGSTPATSAVTTNLFYNAKTGADFAKESLKGGYVQYTTYNLKKARQLFKQGMAEVGQKTLNFTFLANDTPAAKETAEYLQGTFQSLSTTGIKVKMTIKTVPQKSWLQMGTAHQYGMMASIWGPDYPDAENFLTRYTSSVSNFSGSWSSQEYDQYMANAAGKDATKPQARWNDLLKANRLITKEQGIIPLYQWGTVHLTKPSVKGVQYTPNSLFQYIGATNK

SEQ ID NO: 6375 - protein, 355 aa, Lactobacillus casei
MVQIKKIQVFRRPITLHEPFKVAFTTLYKLETLIIKITTDTGLIGYGETNPLEQVTGESIDTEEVALKTLSQALSASDPRSLEAIHAKMDACFAGHTAAKAGIDMACWDLLGKDTGLPVYQLLGGTGNVLTSDCTIGINSPEKMAQEAKRLVDQGYRELKVKVGIQDADDLAAVQTIRKAVGPTVDLRLDANQGWNPKQAVRMMRAIGGAASAVEQPLPANRLDQMPAVCRQIDQLVMLDESVHNASDAFAAVRSNACDIINIKLQKSAGLSGAEQINAVAEAAGIPCMVGCMAETRIGIAAAAHFVAAHQNVQYADLDSFLLFDEPAWLRGGFTADAGKYQLSDKPGLGIECDL

SEQ ID NO: 6376 - protein, 680 aa, Lactobacillus casei
MTTFKFYQSGLHFGTFELTDQTITYSWLGSREKTLNDDDNAIFKTYGELDIQATLKRWQDGGYADFSKADHFKTAWGAEYQRADEHHWMNRGPKYAVDLIEADDQIVGFQVCARNLTSVLIQPGYEGYSVLAKWQEAGYTATPGHAHQPFTAWAPMRDGVGLAARVILPAGSGPFPIVMERTPYGREVYVASYMRYVLRGYAVVLQDARGRGDSEGEWLPMIHEQDDGDDTLDWIAAQPWSNGKVGMSGGSYGGYVQWAAAASGNPHLQAIVSMVTAGGPFTDTYYRRGAPFMAQVAWSIATDGRHFNSALTDRDDWDQLMKVRPIEKIPEIVLGHPQYGMTQFMRHNHYDSFLNRGDWFARRDKIKVPALIQSGWYDDDGIGSTEAIAATADYPSDKRRIILGPWLHGGNAQYDLGPVHLGAEALRPDIDLIHQQWFDHFLKGVENGVAAGPLVEYYTVGEERWHTAASFPPAGLVKVLHLGTDGSLAASAPAAGTVSYVHDPSNPVPKLISVTQNEFEFPADYQEVEKRPDVVSFTTKELTTPLRVVGQVKLDLWASSSAVDCDWDFRVLDVTPDGQSIQMAEGTMNAKFRDSLSEPKYLKPSKVTHFTVLSQKTSYELPAGHRLRVDIQSSAGGFVFPNPGTEEGFASDRFVKATQTISCGGEHASAIRFVSDQPEN

SEQ ID NO: 6377 - protein, 288 aa, Lactobacillus casei
MNRWKKIIVTGIALVSLLTLVACGKAANDSSAASSSSKPIVLGSSGSDYQIWQHIAKSPQAKKAGLTIKVKQVTDGNVINASTAEGQLDVNAFQSYAYFQQYNKINPSQKLAALGTTYLEPMGLYSKKYKHLSDIPNGATIGISNDPANATRGLLLLAAAKLITLKPNFNALSTVKDIQTNPKQLKFKEVETTVQTLPDVDAELISNTRALDGGLNVLKDSLFHEKLTQKTRANVNILATAAKNKNNKQFKKLVKLYHDPTLQAWIKKTFSGTKLEVNKPISYLQKSN

SEQ ID NO: 6378 - protein, 49 aa, Lactobacillus casei
MIAALATITVCISSFTVLVNAFTRLIKALRKLCFAVYELKQALGLFRKK

SEQ ID NO: 6379 - protein, 338 aa, Lactobacillus casei
MCSSMTIKSLQGDIFWGRTMDYNTSFFHETPAGGVPGKIVSLPADHQLPAQSGTWTTKYAAVGVGVDQSVALFDGVNSEGLAGDLQVLVECSWASAVSLAKRNLKPIKGEEFVSLALTTCKNVAEVRELAGQYGLIDEPLQFGGQGVKIPLHYTFVDPSGAGLVIEPTDHGAFKLYDSIGAMTNSPEYHWHTTNLRNYVSLNDRNYPEGADLGDHHLDPIELGTGYGMFGLPGDYTSPSRFVRAMFVSRNLDPFESKDGIRVLYNAFKTVLIPQGLGRDPKHDILTDYTQYWSGYDLSKRALYVQDSNTLTMTTKTLDPTVTEVTYDDLVKTEQFNQL

SEQ ID NO: 6380 - protein, 325 aa, Lactobacillus casei
MDYQEKLQRHASKEIDLYWSDFQKSDDYAALMQDPDFRKVPPKEIRAILVTFFAASFKNLRSTIQTLSAESVSIALETTLQQVNDDDRRRSEAIAVASELIKAMMIWLIRTKRVKLTIVDFIDALMGALLTTTYVLGLVEDGELASPMADDSDGRDIGFDPAGDLDVDSESMSILVDQLMVFFDSKAWHHLPEATQDEEFFGAVIFFLIHTIQAMFGHEPKEWTSQDIGAALLLLLRDTKLVPPDKQEGLGQSLAIFIKSTASTHLWTATQMKSLADTAQNQIKEALTKKPVPRKGHAKTAGHADSDQIIPMAEWQKNKRQKRQR

SEQ ID NO: 6381 - protein, 564 aa, Lactobacillus casei
MIKHKAIMIGAGLANMAAAVYLIQEGHWQGNQITFYSLDDHGSNDGAPAADAADEYWNKVHPMENTKGYVARGGRMLNYRTYVDLMDLLSRIPSATEPGLTAEEDTRQFDAQHRTFDKARLMEGGIGIIQAGHLGLNNTDRLLLTKLIMMPDSEEEKLDNVSIADYFKDDPHMFQTNFWYMWETTFAFRIESSAQELRRYMHMMIYEFTQIEHLVGVNRTRYNQFESIMLPLINYLKDQGCRIILNRRVTDFEFKDTAMTDEITVTGLNMLNTETAKTEHVDVDDDTAVFFTNGSITDSATQGDFDHPAVENMDQGAAAGLWKQATEHFYNLGNPDKFFADRAASEWVSFTLTTKDHLLLNEIERITTQLPGNALNSFLSTQPITALGQKDVMMSIVVHHQPHFTTQKPNETVLWGYFLYPRRYGEFVNKPYIKMTGKEMALELIGQLAKVDPGPGNIRDHQDAIMASIINNIPVYMPYASALFNNRAKVDRPEVIPAHSTNLAFTGEFVEQPFQMVFTEQSAVRSGEIAAYHFTGIPMSHLVQTPRYDKDIKTLMRATKKMFE

SEQ ID NO: 6382 - protein, 42 aa, Lactobacillus casei
MKKLLWTALSLALVTGGTAWYFANKMELFKDDADAYKKFESR

SEQ ID NO: 6383 - protein, 190 aa, Lactobacillus casei
MLMATSDQTKRQLATTLKQLMQHKPLDRITIAELSAATHVNRNTFYYHFEDIYGLLKWTFEADIGRKVMKNLGAATWEAKYRLVLDYILANQAFCLNAFNSVGRDMLEEFLFQSATDMVKPVVLDIDPTTPAKMVADICNFYAAAIVGQVLLWLSQSLQEPEDDLIKRADLMLNGSIAFIVHKQAHNKRT

SEQ ID NO: 6384 - protein, 122 aa, Lactobacillus casei
MAMGMLLVSHVPAIASGLETLIKQVAKDVPITTAGGTSDGQIGTDLDHIQKAINDNPASELLVFYDLGSAKMNLDIAEEVSDKQMHVYDVAFVEGAYAAAALLEANVTLDKIEAQLKPLKVK

SEQ ID NO: 6385 - protein, 193 aa, Lactobacillus casei
MLNVETLTKWMTNFENRIADQKDHLTELDRVIGDSDHGNNMERGVNAIKAAFEKTPPTDDLAQDFKTIAMAMLSKVGGASGPLYGTAFLEMAKLAKTDTDFGDLVEAAAKGIAKRGQAKPGDKTMLDVWAPAADLIKQNKLTDDAIDKLVEATKPMTAKRGRASYLGEKSVGHIDPGAASTGELLKAYLDARA

SEQ ID NO: 6386 - protein, 339 aa, Lactobacillus casei
MKKIINDPGDIVPEMIAGLTASYPQYLKQIPETTAVVRNDAAFKQHAKVGVISGGGSGHEPLHAGYVGQGMLDAAVAGQVFTSPTPDQIYAAIKAVNQGEGVLMIVKNYSGDVMNFDMAKDLASVDDIKVESVVVDDDVAVKDSLYTQGRRGVAGTIFVEKILGAASEAGLGLDDLKKLGDAVVKNTKSFAVALHAATVPEVGKPGFDLKPDEIEFGVGIHNEPGTGQEKLPTSKVLAKQLIGKLTVEFKDPKAHKYAVLVNGMGATPLSEQYIFMGDVLNELHAQGLEASFTKAGNYVTSLDMAGVSLTMLALDDPQWLTYLNASAHTVGWGDTDVKR

SEQ ID NO: 6387 - protein, 142 aa, Lactobacillus casei
MQDERWNHPLYTTEAINDEGLEGHAYVPGGLKVQTSSPMNDHPGTNPEQLLGLSLSTCLEATLEAVEKEHGLPHTGAVRVKVAFIGARAEYQFLVHAQVMVKGVDLDTAKSFTEEIENRCPVSKLLKNSGNYTIETVTDFDD

SEQ ID NO: 6388 - protein, 59 aa, Lactobacillus casei
MRKLWIAAFATFFIASVLGVLYGQVGGGLLLVTALAFGVGNDIILIVILYKSISRIFKS

SEQ ID NO: 6389 - protein, 292 aa, Lactobacillus casei
VADYAAGSIYREVRRRRDLKIKEVKADLHQSTISHLEHDQSDMTLRTMMKILQPTFMSAEEFCHLIDDKRETATSIFKQIAHYYDSTDLTGLTQLLKSYKEKSQPTTPNRLIELMIQSFIDELSERESSLSKDDCDFVQDYLLQPGRWFSFEYISFANLVFSLPGKINLRIAKKMFHAYQQFHLPSYDELLVNALYNLSASFIDQDDPSSATRLLNFLDLEKLDRHVLYMRHHVTFLKLMIQFKLEPLNRENLNKLKVFLKATKLIDETLFEKNIDWLKSLKIDPDTILENA

SEQ ID NO: 6390 - protein, 94 aa, Lactobacillus casei
MPYIILEVVMIVAIILLQTFFGYIGSKILGAILPVSLVVAYIYFITQGQIHFSVIDIVLPIVGLMALISIWEGGRKTKLSQQKKKLQKTKIQEK

SEQ ID NO: 6391 - protein, 470 aa, Lactobacillus casei
MARSTNRKRKMRSPRQARRQLNKLLRDPIAKPHNAAAVRIRVDELMALFQHREYRPHQSATVNRVNIQGNVQFDLARWYPEGSRLRDMLRPRGPLLPIMFSVQDFGNHRKSLARGLTLAVSSAARQLDQMRAADKLPIIMQPFSDWVHLLALGLQNWLENGQVVFSLLDLKGTYVLTTMPTAPATWLARLFGISLGQADQTLTDLRHQRQEQADRLTTKLAAKFAQEKAPLVQSANQRAAKSLQLDPPTMAQLASDQAPLKTQKDVIDRLARGDYIVIDTEFVADRNQLDLTEISLLRVRGHQVAGAFDIFTQLPEGHHVMPFSVKITGITDDLLNQYGQPLPLAKTAVEQLLKHELVVGFALSNDLRALRAGLAIDVPPVQTFDVATLARKTFGIGKKHTPSLQYYKEALGIDLPSHTALSDAQTTMALLEHLIWEGSPLITKELGFEQRPPEHANDPEPYQKPDLSDK

SEQ ID NO: 6392 - protein, 97 aa, Lactobacillus casei
MDIKQSTDATAFKQRIFFALSEPGRYTIVRMLYHVGHEMGCNELNQHVEIDKSTMSYHLRTLREIGMITTRVQGRQKFVTLNTDKIESVFPGLLAEL

SEQ ID NO: 6393 - protein, 388 aa, Lactobacillus casei
MKERRLSLLFFLVMFVIGTDTFLVSPLLPTLTRYYGISTSLSGLIVSAYAVGYMLSALLIGPVSDRHDRKRILVIGLIVFTLATAGCGLANTFPLMLVTRFIAGIAAATAGPQIWAAIPVLFPKCQVVKVMGYATAGLAVAQIVGVPLGSYLAVISWRFPFFFVGTIALILTLLVARFMPSLNEVRTAQPKSSIYGQLFQNKPVLKLLGAYLLFQTANFTGFAFIGTWFAKSFGLSVGTIGSFILVIGVGQFVGSLIGARLVTWLGQPHAFLLEFLLFISGYVVLPLASSALVATIILALIYTIGGALLPLFMSTLQDQARSARGTISSLANAVMYLGEAIGGVVGGILIKQFTGFSGIAVFTAIGVTLAMLLYARQGYFNYGWPKIP

SEQ ID NO: 6394 - protein, 213 aa, Lactobacillus casei
MFAVRKEDAIMQENLAQEILLLLGSGRFLTTKEIAKLLNHPESSVKSELLKLVHAEKINRRHFAGRDYFQTVKPQTEPNILSTAAEQYLDRRHAAEKLGDARTCYHHLAGKAGLALFDQLLTQKLITLTTANAYRLTEKGQHVLARYLGHPVRQEKVQTCIDFSERRVHLAGKLGDELLTKLVANHQMTLSGNRLVRVLHPIDQQSLAVSHVS

SEQ ID NO: 6395 - protein, 191 aa, Lactobacillus casei
MSVERQRCAWGETGNALMQQYHDEEWGRPSHDSCHLFELLSLEIMQAGLSWQTVLNKRSAFKAAFANFDYRRVQQMTPEIPVLLQNPQIIRNRLKVTAIINNANAIAKLADKGENFDHYVWAFVKNRPIQHHITSHAEVPNTTDLAKRMGKQMKKDGFSFTGPVVIYSFMQAAGLVNDHETSCFVYQLLEK

SEQ ID NO: 6396 - protein, 66 aa, Lactobacillus casei
METTIRKFGDSIGVIIPKEFHAKVGEKYQIHKIADTFVLTPVHKDLFADETEWYGFRDSVTESDRE

SEQ ID NO: 6397 - protein, 90 aa, Lactobacillus casei
MASRSGINVEVDTETKDRALRVINSMGLDMSSAINMYLKYISDTGELPFTPEIIVEGQLQTAEADVKAGRTKSFKTVGALLKDLHNDIDD

SEQ ID NO: 6398 - protein, 293 aa, Lactobacillus casei
MPLVNAAELVKAAHKGHYCIGAFNTNNLEWTRAILAGAQELNVPVIIQTSMGAAKYMGGYEFCQTMIEATVKAMGITVPVVIHLDHGNYEAAKEAIAAGYNSVMFDGHDLDFEDNLEKTKEIVKLAHAKGISVEAEVGSIGGEEDGVVGEGELADVEEAKTLAATGIDFLAAGIGNIHGQYPDNWKGLHFDRLQELNDAVKMPLVLHGGSGIPQEQVQKAITMGISKLNINTECQLAFAKATREYIEAGKDQQGKGFDPRKMLKPGTDAITDTFKEITGWIGNKPVKMVPEAL

SEQ ID NO: 6399 - protein, 577 aa, Lactobacillus casei
MATKAADQLVSVLMDWQVKHVFGLPGDSIDTTVDALRRHQDKIKFVQVRHEEVAALAASATAKLTGGLGVCLSIGGPGAIHLLNGLYDAKMDHAPVLALLGQVTTSNLNEGFFQEVNTPKLFDDVAVYNKTVMASDNLGQIVDTAIRTAFTEKGVAVLTIPDDLPDQKETTSYRDSAAAFALNVPEVDPKQLDDVASLLQKSQKPLALIGRGAEHAGEQVQKFVEANHVPFIQTMPAKGTVADDHPNSLGNVGKLGTKPAYEAMKATDLLFMIGTNYPYTPYLPDEGQAKCVQIDTQPENLGKRYSVDVAVDGDVENFLTELNAKGSLRDDDRFLKACQKNMESWDKWMAEKRLLTTNPASPEAVFATIDQTAPKDAVYSVDVGTSTSWGARFLNVQPTQKYTISAWLGTMGCGLPGAIAGAEAFPKRQNISVAGDGAFAMVMQDFVTAVKYKLPIIMVVLNNQKLAFIEYEQQSAGQLNYEIDLADMDYAKIAEAAGGVGYTAHSNDEFKEALTKAYQETDKPVLINTYVQDDAPLPGKIVGEEAKGYMKYGSQYLENYWKIPSMPPLKDIMRQFF

SEQ ID NO: 6400 - protein, 337 aa, Lactobacillus casei
VTDWNGYQAINEKYHLNGATMLVDANHQLSHWQNGMADFAKQEPFTIHTTSGLGSLSKQFTADSMLLLDADGALNIDAPLSDYLPEYRYAKQITLRQMLHMASGIPDYTELLLAEYTKKMPNASESHLSYPILEDLVQGNALQQVLDLLNRHPLDFAPDEKGVYSNSNYFLLGHIIAQVANMPLGDFIERHFFQPLGMTQTRFGTQAAEANSYDDLDFTNGQPVALGRGDYTGGDGAVVSSVTDLAKWAQATLHQEILPASAWREALTLTHDFYGMGWMKSKTPGWLAHNGHVFGFWAYFDVSFDKQLTHITLNNMSPSTEARKAWHKEMAVWLSTL

SEQ ID NO: 6401 - protein, 244 aa, Lactobacillus casei
MAAIYDNPDFFKAYSQMDRSKKGLAGAGEWHELKTVLPDFTGKRVLDLGCGYGWHCRYAADHGAKSVLGIDTSAKMLAKASEMTDDKRITYRQLDMQAIDQLPGQFEVILSSLAIHYIADYAELVGKISNKLPIGGQFVMSVEHPIFTAQGNEEWVTDEQGHNLYWPVDRYFDESKRETDFLGHRIKKYHRTLTTYLNTLLDNHLRLDRVIEPTPTAEMVKTIPGMADELRRPMMLIVATTKTA

SEQ ID NO: 6402 - protein, 250 aa, Lactobacillus casei
VKLRIGIPTDELIEVNPVMPNNHPAYVPHDVKEAFIHLGALPLVLPFPDDVSQTEQLAQDDMALVDGLMLPGGPDVDPTLYGEEPHPKIGMTLYQKDLFEIALIKAALAANKPIFGICRGIQIMNVAMDGTLYQDLEQQYPDLKIQHPQATLGQFATHHAELTPGSRLADLYGKETIKVNSRHHQAVKTVGKGLKVTAVAPDGVVEGMESTDNDLFLGVQWHPENMWQQEDPQQLVVFQDFLKRVADHQK

SEQ ID NO: 6403 - protein, 96 aa, Lactobacillus casei
MNNLIIVLIIVAFLAIGPLINFLYIYKRKKKLNELLIRLQNFQQEKMFSQHTLDDMLRGILSERVIVKSNGSLDLSNFMSIRDLEKLYTVLQNSES

SEQ ID NO: 6404 - protein, 70 aa, Lactobacillus casei
MSRLDNLSNPSVIDLSNSQLQQVTGGKKFRECIPNLIGGVLIGSASFTAFGAAFGGATSLSMCMSTNYVH

SEQ ID NO: 6405 - protein, 75 aa, Lactobacillus casei
MDLSLNAYENLNDQSLAVIAGGKGKNCIPGFLFGLAKGAASGAWGGSAIPGIGTIGGAVIGANLGMVGGAIKCLG

SEQ ID NO: 6406 - protein, 141 aa, Lactobacillus casei
LTTALYNSLFYWNFKINYTTAYRLTVEEEIYLNKRQLKNKMFLTSKRKESFLRKTGETWLNSNSLNELALLLIKGGGIERIPHNLKKYRIKRKMTQAELAERLKIDRTAITHYESGSRLPNTAVFIDLAEILDVNLDDLTR

SEQ ID NO: 6407 - protein, 447 aa, Lactobacillus casei
MDDEAVIEQLTEKQTELIEFLYVDYNGLTRGKVIPLASLKAKLADGIGLTKATLNVSERDTILPVADMTPIGELRLIGDAASAHVLPYMPQVATLMGDIYNLDKTPYASDPRTILKRVVKQLADAGFTVKMAYENEFELFTGDKDHREPAMPRVAFSTESMDFAYPFILKTINQLQQVGIMPNAYYPEGGIGQHELSMLPQDPVTAADNEVIYKRIIKNTAKDFDLYASFAPKPLVDSAGSGAHIHLSLWRGQEDAFFDADAPMQLSKTGQYFVGGVLKHIQGLLALTCPSANSYQRLAPGHWSSAYATYGKDNREAAVRIPSTAWGDPASSMNIELKASDATANPYLAFAGLLAAGLDGIQHQTQPGDYCDVDPATLSEAQRNEMGIHRLPQSLNQAVDAFVTDSLFHDVFGPQLIDAYAKIKREDDQYYSKLALEKIAALHRELY

SEQ ID NO: 6408 - protein, 375 aa, Lactobacillus casei
LDDLTEFVDQVPLLDHHCHFLINGKVPNRDERLAQVSTEADNDYPLADTKNRLAYHGFLAVAKQFALDAKHPLAAMNDPGYATYNQRIFGHYRFKKLLIDTGFVPDDAILDLDETAKLTGVPVKAIYRLETHAETFMLKSDNFAAWWQAFSQDIQQAKAHGYVGFKSIAAYRVGLHIEPVNLMEAAAGFDTWKNSGVKRLTSKPLIDYILYHAAPLIMAQDLPLQFHVGYGDADTDMYLGNPLLMRDFLNAFAKKGLKVVLLHCYPYHREAGYLASVFPNVYFDISLLDNLGPSGVQRVFDEAVELAPYTRLLFASDASTYPEMYGLAAQQFKQALIGHFASLPFVDLAQKKAWINAICWQTAAKLYHQEEEFVN

SEQ ID NO: 6409 - protein, 451 aa, Lactobacillus casei
MEKRKKLTLLEVFGLSIAMVAPTGAMSFNTASAAANAGINMPIAFLLGGIGVLFVAISFAELGKRIPGDGSAYAYNAKALGEKAGFISGWLLVLTYVTFVFSSGAIVGNFANVFLSHLGVHLPVNLYNILVLLLGGWLSHKGIEFSTRLTLVLELLAVLVLSVLTVVIIFSGGRSGNSVQPLIPQPHMATGLGMGMVFALMSFAGFEGSATIAPRATNPRKAISIALLGAVSFAAIFYFLVSYAEVIGFGSAHIGDLAKSTAPMNFLATHYLGTNAAIFMDFAAMVSYFACYFGALNAGAFMLEALGKSGYLHPWLAVESGDKQTPTHALDSITGLALIVYVIFAIGLGVSASDMYNWFGTIGMLGLLTVYVLVNIGAIVYFRKDKGRSMFKHVLAPVIGILVLIYPIYTSLWPIPAFPMNTFPYIAIVWFLIGLWVATKRRKVETRLEDF

SEQ ID NO: 6410 - protein, 146 aa, Lactobacillus casei
MSVSYTIGEVAAITHLSVPTIRYYDKEGLIPDLQKDQAGVRCFTDQNLGALEMINCLKTAGMSIKDIRTFMQWNLEGDATLTKRLDFFNQLHTAVENQMKQLEQTLNTIEYKQHYYRQAVADGTEKYVKTGTAHVKAVATEQEQRD

SEQ ID NO: 6411 - protein, 288 aa, Lactobacillus casei
LLEETYTLTNGVKIPKIGFGTWMIDSDDAAAKAVHEAIDVGYRHIDTAEAYDNEAGVGEGVRASGVARENIFVNTKLAAEIKDHDTAVKAIDGSLEKLDLEYADMMIIHAPKPWAKYDEPERYFEGNLEAWRALEEAYKAGKLRAIGVSNFDPTDLKNLLDHAEIAPMVDQVLAHITQTPFKTIDFAQEHQILVEAYSPFGHGEMFKNKDIQKMAAKYQVSVAQLGMRYLLQLGLLPLPKTVNPDHMKANAEVDFTISDDDMAMLKQMKPLTNYGKYQSFPVYSDRLS

SEQ ID NO: 6412 - protein, 340 aa, Lactobacillus casei
MKAIGFTQHLPIEQKNSLEDLTLPTPTPEGHDLLVNVRAVSVNPVDTGTRGAGHARLAQPKIIGWDAVGIVTAVGHDVTRFHVGDRVFYAGSYKRSGSDAEYQLIDERIVGHAPAKLTDAQAAAMPLTSLTAWEALFEKLHIPFDHKEANRKRSILIINGSGGVGSMATQLADLAGLQVLATASRPESQKWVLEHGADHVLNHRQPLPPQLKAAGFKNVDYILNLSHLDEHWNEIATMIRPDGWVAAITENRRGIDLQKLTKKRATFAWEWMFSKSWYGYDLASQGIILDKVASLLNDGTIQCTLTKTLQPLNAANLRKAHALVESGHMIGKVVVAGPWA

SEQ ID NO: 6413 - protein, 114 aa, Lactobacillus casei
MDRELYNCAAGCPVQNTVDLISGKWKSVILYHLFKGDATRFSTLNKAIPSVTQRMLALQLAQLEGDGIIYKKVGDEDGRATEYGLTKLGQTLAPVIDAMAAWGKFYQTQQPALA

SEQ ID NO: 6414 - protein, 249 aa, Lactobacillus casei
MTLETILYLLGMSLIAGILNGTVGMAALTLYPMLLSVGISPITANATNTIGLLFSGSSSVLSSRRELKGHWHQALLITLLNALGGVLGALILIHSSNASFKRVVPFIIFLAGVMILTPKKDPDQATHRKLAQGFGYALIMLVGLYIGYFGAGAGLLMIAVLSRIVAGPYATYNAMRNLASLVNNTVTSIMFIFSMPIAWWVLIPVCIGLFAGGFLGPMIVRLIPSHVIKTAVGIFAIGLAVVLFYQAYL

SEQ ID NO: 6415 - protein, 264 aa, Lactobacillus casei
MAENNLLYSRKNSGDTGGGDVKKLEIAHLDKAFDQQVLFKDANYTFQQGKIYGLLGRNGSGKSTLFNMIVRNLPIDSGTIAVDSDDGQGLITNYSDTAVGMVYTQPHLPAFMTGVEFVDYFIAINRERLERMHTTVKAADFFDMAGLGKADTNKLLRDYSEGMRNKLQIVVSLMLKPPVLLLDEPLTTVDVVAAHEMQQMIVAMKADSVVVFSTHIMQLAQAICDAVVLLHQQQLTELTGLDIHSQAFEDAVIARLSDEVQADA

SEQ ID NO: 6416 - protein, 538 aa, Lactobacillus casei
MRDAWRYYWFQAQTDATTGVNGIIYFLRRIPFLGKKIPTKWYRTGALKSLLAILLNFMMLLTKPVITLLMMGLAFLVGNAYNDFIHPLPSDFTLRIMVAAVVYSLGCLMLRGLIFRYAAINIKTIKLGEYFSLDRVALVRGTLLINQIIVVVIGPFLPLFILALITRNLWLLLVGLEMAIFSWHWQAFLPRLAWSHRQLGLMAQIIYWVSLWGVVAGVMITGQLAAFVNGVFSPLGFIIGLFALLAMAWYIHRFSDDIPFLMASIQQATITLNMVTSSRDQQFLAAGKAMQKKLTLDTKVTVKPTSRSGSNYLNALLFVRYRQQLWKKLRTRLLWIGSIGVGILVLIKLFAVHSVGDLTSIYGGLFFAMYLSSLGAPIVQLLFVNCDSAMLYYPFYRQPKTILAGFFYRFWRIVRYNAVTGGLIFLFIFALQFVSSVPDAVNFYLVLLLEVCGMVLFFSFHDLFIYYLIQPFTDDMSVVSPLYRFLYWGMYWVAWVFTQVQFSGYAYAILIGVVTLIYVAIGTAVIYRVAPKTFRIRY

SEQ ID NO: 6417 - protein, 97 aa, Lactobacillus casei
VIQMNNEDVFKKRYKHFLTFLTFWIAGYFTLDSLFSGLPLPLTVFSSTVVPISFLSYLVYDYFKLKVKRPASLIFLVVMLAAFIFAILLFLKIVVLF

SEQ ID NO: 6418 - protein, 844 aa, Lactobacillus casei
MSEAAHFYETFQPSHYDLYLDINREAKTISGKTSIIGEAKQPNIAVHQKYLKVESVEANNQAVPFTTDDPAEAVRITLPKAGDVKLTITYTAPLTDTMMGIYPSYYEVDGVKKQIIGTQFETTAARQAFPSVDEPEAKATFDLAIKFDERPGETVISNMPEVREINGVHYFDTTVRMSTYLIAFAFGELQSKQTTTKSGVKIGVFATKAHKPNELDFALDIAKRSIEFYEDFYQTPYPLPHSWQLALPDFSAGAMENWGLVTYREALLTIDPDNTSLETKERVATVIAHELAHQWFGDLVTMKWWDDLWLNESFANMMEYVAVDALQPDWHIWEAFQTLEVPMALQRDATDGVQSVHVQVEDPAEIDSLFDSAIVYAKGARMLVMVRALIGDDALRAGLKAYFEAHKFGNAAGADLWAALGQASHLDVGKIMQSWLEQPGYPVVTAAVVDGKLTLSQQQFFIGAGKDVGRQWQIPLNSNYAVAPQIFADKQATLGDYAQLRQDSGEPFRVNVGNNSHFIVQYDQTLLTDILDHLDQLNAIDQRQILQDLRLLAEGRQNSYANIVPLLPRFAESHSAIVINALYRVANDLKQFVTPDSSDEAQLKAFFDQLSAGQFKRLGWLPKPNETNDDQLTRPYVLSMALYAKNATAIAQGHDLFTANKDKLLQLPADVRMFVLQNEVKNFGSAALFDQLLTAYKQTTDSSYKADILAALTSTPDKALIGKIVDQFENADTIKPQDLRSWFRGVLNNHVGEQAAWDWIRKEWSWLEKTVGGDMEFTTYITVIAGIFRTANRLDEFKAFFEPKLPTPGLTREITMDTSVIASRVDLIQAEQQAVNGAVAKAVK

SEQ ID NO: 6419 - protein, 480 aa, Lactobacillus casei
VADTKKQLRWYNVALIAFVSVWGLGNVFNNYAQQGLSVVTSWILIMLIYFVPYALIVGQLGSTFKDQAGGVSSWIKETGSVRLAYYAAWTYWVVHIPYLAQKPQAILIALSWLFKGNGNFVNTVSSMTVSLICLALFLLFLWLSSRGLTTLNRIGSMAGTAMFLMSILFIILAVTAPLMVKGVHVATPDMGDLHTYLPKFDLNYFTTISMLVFAVGGAEKISPYVNNTKHASKEFPLGMLVLAGMVAFCALLGSFGMGMLFNSHHIPTDLMSNGPYTAFAMLGNYYHLGNIFVILYAIANALASISALAFSIDAPLKILLSDADPHFIPKKLRRINKKGTPINGYWMTGILVSILIIVPALGIGNMNELYKWLLNLNSVVMPLRYLWVFLAYYLLNRHLEKFQADYMLVKNKHAGMLIGGWCFFFTAFACLLGMLPKISYLSDPGTWWFQMGLNVITPVVLLALGLVLPMLARRNELTTE

SEQ ID NO: 6420 - protein, 444 aa, Lactobacillus casei
MQKKPTAQQTKWPERISYGLSDAADNLVFQVMTTYLLYFYTDIYGLSAGAVALLFLIARVADVFESPVVGLMIDHTHSRFGKSRPFFLWYALPYAVFAVLTFVTPNWSANGKLLWAYATYLLLGFLYTAVNLPITSVLPTLTQNQQELTLLGVIRQFFGSSVQIIVAVFTLPLVAFFGRGNDQHGFLLTMALFAGISLLLILNTFVHIRERFTQKKIAHQPFRVVAKIAVRNKPWLILSGVIFTYWLLTAIKNQTTVYYFKYTLHNQNLVSWANSFTFSSLIGVLLIISIAGHYGNKHTMRLGMLIGLAGQLVIAGGVYLRQLWLLFFGILVNSIGQGMIVGLVSIMLADTIRYGITLGAQAEGFFASSNDFGVNLGLGIGGLVTAGLFDLTGYVPNTSQNAATLGMIDLNYVWLPLLLYGILLLLIHFYPEKKMLTAIREHHL

SEQ ID NO: 6421 - protein, 166 aa, Lactobacillus casei
MRTQTQSSVLKLAAVGAVAGLVSGLVKLGWENILPPRTPERDATNPPQQFLQQHGLTPAETHATYTYSGHQIPWVSLLVHFGFSSSLGALYAVAGHYVPLFKLGYGSMWGLGVWAGAHLWAMPALKIVPPAKDQPAEEHLSEAVGHMVWNTVNQIVISDMLREKHD

SEQ ID NO: 6422 - protein, 297 aa, Lactobacillus casei
MNLFHLRYFVTLAKLQNYTQAARQLNITQPSLSNAIHRLEDELGLALFVRQGRNIVLTPEGREFRRIVEHSLTILDSGIEQLQHQNTEQTVIKLAALRTLSTRWVPGIVRSFLQQSHDDVRFEFTNENGLSPQIIQGLRSKNYDICFCSKVDEQEDIAYFPIASQELVVITPLDHPLATRQRIELSETLAFDQVTFSKRSGLAPIIRQLFAECGGQPHSVYAIEEDEAVAGLVANGFGIALVPNMPILKTLPVKIIPLSFPTWQRIFYMATLKDHYQSPAATDFIDFVHAHHADIHQ

SEQ ID NO: 6423 - protein, 288 aa, Lactobacillus casei
MTLAHPITVSSWTLGDQCTFEDRVKAAANAGYDGIGLRAETYVDALNEGLTDQDILDILDRYHIKCTEVEYIVQWCEEPRSYEQKYKEQTCFHMCHLFGVEHINTGLMESYPVDFTAKKLQQLAHRAALAGDLIIALEPMPYSGMPDLKKTWAILQGAGAPNIMMLLDMWHWVRADQPFDLLTKEQAKRVISIQLDDAYKRPYAKSILRDESMHDRLAPGTGFEDRTEKFIKMIKDAGVDPKVIGVEVISDQYMAKGIDWVAKYTYDNTVKTLQAVWPEILKPAVATH

SEQ ID NO: 6424 - protein, 277 aa, Lactobacillus casei
MADWLGLKDKVVVVTGAVGGMGTRFCEAFAEHGANVVLVDIKKEATETAAKALSEKYGVQTLPLATDTTNEDEVDNAVKAVVAKFGQVDILVNTAAILRFAPFEDLRLDEWKTALNINLTGYFLMSQRFGRQMIAQHHGTMVHISTVAAVFPETYSGAYSTTKAAVNMLSKQMAAEWGQFGIRSNCVMPCLVKTPMSADFYKDPKVLDGRERLVASRRIGDLDDITNAVLYLSSERSDYTNGGELRVDGGLGIMMQDMIPKPGGRREYAIKAHQAKK

SEQ ID NO: 6425 - protein, 289 aa, Lactobacillus casei
METWISGTTGLLCLLGSPVGHSGSPAMYNFSFQKQKIDAAYLAFDVKKDQMPQALDAMRLFKMRGANITMPCKNVAATLMDELSPAAKIIGAVNVVVNDHGKLIGHITDGIGFVRNLKEQGVAIKDKRLVVLGAGGAATAIQVQAALDGARQVTIFNRQDEFYPRAEATAKKLAKAAPDVEVVIEHLEAADKLKAAIAAADILVNATTVGMKPNDGESLVNPDFLRQDLVVADTVYNPLKTKLIEDAEKIGAKVAPGKGMLLWQGAAGYKLWTGQDMPVKAYQAFEAGQ

SEQ ID NO: 6426 - protein, 405 aa, Lactobacillus casei
MKTKHNHFLPGALALYFSYAMLGIASSILSQYKAQFAANWGAQQLSNGTIDVSMVVSVIAAFGLGRLIAYPFAGPVSDHFGRKVSGTIGIALYVVFFVGIIMVHQFWAAYLIGILNGMANSFLDTCVSPSLMEMFPESASIANLLTKFAVVVAQFVLPFFIGGVAAAGLSFRTIFIICGVALAADALAIIVFPFPKREKPQLSSTGSPEKMHFSLGSVAAILIGFTSSTTFMVWLNCNQELGLAYGVKNPATLQSLYAVGAGIAVLLTARLIKSGLKESTVLILYPAIAVVMLVLCYFVQTPTILYIGSFVIGYAAAGGVLQLATSTTINFFPSHKGTATSLVMIASSIANYAVLSAAAGLTKAFGDAAPRMIILLNIGITIIGIGLALIVKAQEKRVLEVARAH

SEQ ID NO: 6427 - protein, 299 aa, Lactobacillus casei
MSLKDEIDGHTALAGLFAHPAGHSLSPAMYNATFEKLRLNDAYLSFDVDAPELAHALQAMRSLHFLGGNLSMPNKQKAIPLLDKLSPAAKLIGAVNTIVNDHGVLIGHITDGTGFMEALRHDGLDIRGEKMTLAGAGGAGTAIAIQAALDGVSQINIFNRRDASWQNAQRNVAIINDQTHGHAMLFALDDQAALKASIADSAIYVDATPAGMKPLEHVSNVPDGEWFMPETIVFDTVYAPRETKLMQIAKQAGVKHVYNGINMLINQGAAAFHLWTGLQMPVDDIRETVFGEPAVVTHA

SEQ ID NO: 6428 - protein, 275 aa, Lactobacillus casei
LTKSPLKIGILNVMHDKADTKTRLQHVLTRTEIPVELHFYYPMTHYAGRDVPEAVSSILDPLDIHEAATMDGFIITGSPIETLEFDQVHYIAEVRTLLKTLGQHVPNQLYLCWGGMVALNYFFGVSKLILPHKLFGVYPQTILEPHPLLQGLKDGFKAPHARYAEMDVRDIRTDPRLTINATTTKGKLFMVTEPTNTQTFVFSHIEYDRWGLDAEYHREIAAHPEIDYARAKHYYHHKNDYDHPKFNWKKTQRTIFDNWIRHVADHRNEDRSMPI

SEQ ID NO: 6429 - protein, 309 aa, Lactobacillus casei
MVTAADNITGLIGNTPLLKLNRVVPEGAADVYVKLEFFNPGGSVKDRIALAMIEDAEYKGVLKPGGTIVEPTSGNTGIGLALVAAAKGYHLIITMPETMSVERRALMRGYGAELILTPGADGMPGAIKKAEALSKENGYFLPMQFQNPANPDVHERTTGQEIIRSFDGGTPDAFVAGVGTGGTLTGVGRALRKINPNVQIYALEAAESPMLKEGHGGKHKIQGISAGFIPDVLDTNLYQDIVEVTSDQAIDMARHVSHEEGFLPGISAGANIFGAIEIAKKLGKGKSVATVAPDNGERYLSTDLFKFDD

SEQ ID NO: 6430 - protein, 218 aa, Lactobacillus casei
MMNLEQDRKKIKAISVGYIRVSISEDRQKLGYDIQKRKLKERGVDYIYGETLSGRKDDRPEFLKALSKAKTLAAKGYQVTFVVYKLDRFARKMSTILNVLEDLKQAGVNFMSLSENVDTSTVSGIMMMQLLGVFSEFEVNTIRARTREAMAQAKLEGKIIGRPPLRGSVKEKVAELYQKTALPVETIALRCNVSRRSVYRIVKIFGISRRKDEFNGGK

SEQ ID NO: 6431 - protein, 822 aa, Lactobacillus casei
MEMTRKQRQMEMALEERIERKRLVHSKRLGWLTLGMASVTLAALGATNTTGQVVSASANNNIKTNQVTQTQSSGGRDWVLRPVADIKAQFEASDKTVYDIKWGDTLSTISEALNESGVTTSVDRLAEINHIANIDLIYAGAKLRIAGTGDNATVTTKDSTGTNQTYNLNPAKPATVNPADRAKTSTQTSTQPAGTKGSTNKTNAHLNGSSNALNSKNQTNQAPGNGTYDASKAVTNSTQPVKPVGPGNQGNTDDPAKQTTVTVNAVVMGKTVKQLAQFKAVIGKEGTYTAPESFTVDGVEYDRIGKADWPFVVKPGLVVNVGYIAIPTTKDVIVNAVDADTGKMILSKRYTDIKNTGHQKFSVADAFGEQLKDAGYTLVGADTQDLVLNKDAQTVTFKFKKTNPSATAITIKAVDESGNEIGQFLKSGESGKLLTVTAPVINGYDVQGDKEQTLTVHDGATITFTYKVHQAPAKSTTIQVKAVDESGHLLKSDTKAASIGERVTVNAPMIDGYDLQGTSQQTVTAKDGLTVTFAYTKHVVVPASANIKVQAVDENGTVLKSETQTAQVGKQIAISAPTVDGYDLQGAQQQTVTAQDGMTVTFKYHKQDEQKYPTDITIIAEDDGHRELKRYTQTANIGDEITVDAPDIPGYEVQGAKQQTVTAYSALWVTFVYKKVPNPIDINVVTQNLITLLNQYRVSKGLPALRVDTHLMAGAKVRSEQEAEALNAGQELDHQLPDGEDFDKEANLKQFAGFVDGENAGANWRKDEDTNLSLAQKLMDQWKSDAPHDENMLEPRYTDVGIGVSSGNDGMYVAVQDFGTRK

SEQ ID NO: 6432 - protein, 1139 aa, Lactobacillus casei
MQMTRKERQLQLALAERVAHKRLVHSKHLGWVVIGMTSAALGGLAYVTSGPTQIVGARTSEKEPSGQVTTAHARTNQVWTLRPVSEIKAQIQASNKKIYDIKWGDTLSTISEALNESGITTSVERLAQINRIANIDLIYAGAKLYLQGSGENATVTTKGSNGNAQTYNLNPSKPAVASSSDKVAVQTDKGTKVVPSKTEDVKVGQTTSTFGGGQTSTSISTMPIGTDKPTTPESSTDKAVTLTIKAIGPDGKILKTRNILGKVGSNVTVSAPQVAGYELVDGVSTVKHVKLDNGNTSVEFMYKRVVKNISKSVIINKDDQGDTLPNKPDLSKYRLLTSTSKTEVQTMSNGDTMSTTTTTVTYHKIARKTQRVIHNVDESGNELASTEGLMLLKTGTTYKDIVADNGDVTTILTTTNVYKKSPVNSKTGTITVKYVDADTGDVIKPIQTLTRNVGDNYEVAAPQIEGYILEGNNSQSVTVSVDGNTITFSYKKKAGVHDTSKYVIKNIDEQGNSLGDKPDATKYHKISESKPEKTNVQKLPNGDTVTTYTSTITYHKIVNTNKAVTTNVDETNHALGNNPDTSKYKRMSSSEARNTSIASNGDTTTTVTTTFVWHKIVNVNKTVTKNIDEAGSDLGQEVSTTDFHKLTTSTPVKSVATAENGDTVTTYTTTVTYHKIARTTKHVVINVNEQGQSLQSIDGYDLVKSSDTSTNSVADNGDVTTIITTTSVYKKSVVIPTTAKVTIVAREVDGGVLKTSVVDAEIGSTYTVHAPAVDGYDLIGEQSQQVVVSAEGNTVSFGYEKHKPTPVYSTVTVIEKNADGRVMGSHSVQAEIGTNYVAEATQYGGYDLQGPNTQTIRVSPDGNTVIFVYKLHVYKLDTDAIANRLAQLVNEWRQQNGELPLKQDPNLQAGSAVRAQQEADAANKGGINAADHYLPGGQIFSFEPHLKQYDSYHMAENLLVTTGHDVESVAQGAFAQWKNSADHNANMLGTYTDEGLSVVQLDNGMFLALQDFGEKPKFNWDVTPFTFHGKQEQYLSVLKSAAGVTDQDVIDSANRQGIGNVFEGNYYISNHMLKTKDDLDGWIVSGYDDPNMQKSIWTQGKAMVGIAVMKDGTIIGYVPVDRALSKPANQLIAEGYIPW

SEQ ID NO: 6433 - protein, 439 aa, Lactobacillus casei
MRKIFTLFSLISILFLSGCNSSTSPPSKTSKVIESKSNIMKVVGRDFAGVYVGKGTTKDPTYRYSIHFGQNGQFVQDIIASKGYAGRFTEKGTYTIDRKSKKIVMTIKGVTEERFASDNALTAGEAPTAFYERHDSSSESPLNEAEDHPIDIKIGAEHLIGSVNGVKLYPTKKATVNYTKHYDAEEAKYRKSGGWVSGRTFGTGGILISFKAGKFIFQFATLEDPIHTVTSAEGTYTLSSSGRKISLIFSSFTPLYKGPKAEYYQYTTIARSPFENIKTANLTVISENELRSDAIGSIEPLSLGSEDAGDHYPSLMNQWSVTNTKDKMRKVQNLGVTDIFPTEDDFAKWVISAATESDGSDIELTGKGTDVTEDDERVDATFKYEASYLRAGAAVPGIVGITADGRLYAYIILTKGRYMQPSQFWQDKYEAYRDLKMDN

SEQ ID NO: 6434 - protein, 389 aa, Lactobacillus casei
MATFRKRGKYWEYRVKYTDSAGKQLVASHGGYRLKSSAQDAAEAVEDDLKRGGDPSKQDVLLLDYWDQWAEAYRINGKSINTVYRYKLFRKHLKSRFDGRKLNSIRPIEWQKFINDFAAGKDRKEKTTRKRPRERSKDIVTKMNSYVRGMVKAAINERILFSDFTFGTKTSGVRSSGKVKVLDSRDFAKVKAIAIERASYRNIGALAVYIGSMTGMRISEVLALTWPDIDTKLCVIHVTRSWDHLYGTGFKPTKTDSSVRDIEISPSVIELLNKIHQEQAASYLRTGYRDEDQMIMRDPRHNVITDSACNKALHVIQNKAGIPEDKQITFHGLRHSHVSYLISKGVDIYYISKRLGHSDVTITMKVYGHLLDSQRKQEAHKAVLFMDQL

SEQ ID NO: 6435 - protein, 86 aa, Lactobacillus casei; identical to SEQ ID NO: 3201

SEQ ID NO: 6436 - protein, 206 aa, Lactobacillus casei
MEMQQLILAGIPGFLTFIWLDKLDAIHFDLPARQADRTIALILISMLNAAGGLAIYQQIWGTVGHSFWSEFGLFVVTLILSVPLAFTYYFLIKLGNSCLIWIQEQFHVATVLPGSPLVEALKNKEYSEEKLVIIFDFNDKLISSGYANRLPGSDDPTQQIGLMTYGQDWTVKLAQKKYDESPQNSEQIIDFDRQLKIYIIGINPYS

SEQ ID NO: 6437 - protein, 235 aa, Lactobacillus casei
MNLLPEDQVDAGQAYDGLGNSEIIDTAFENKIWQLSKFAALNQPVSVDIDGKVYAEIRQTKYFIGKIPNDKVKTFSALYLNDKVELWVSIHGGTYKQTSTRSDGSITVKTYRDPVTLKLIAEDQQPAKTLNNNSGEEWSEVGKKMYAAKRKPYCLNCKHQLKGERFCPTCGAKIIYPGEHQNGMPINSWEKVANGADKFSQSVDKTGKFFSDFGCAMTLGCTIPIIIIIILFGLI

SEQ ID NO: 6438 - protein, 143 aa, Lactobacillus casei; identical to SEQ ID NO: 2801

SEQ ID NO: 6439 - protein, 117 aa, Lactobacillus casei; identical to SEQ ID NO: 2800

SEQ ID NO: 6440 - protein, 82 aa, Lactobacillus casei; identical to SEQ ID NO: 2799

SEQ ID NO: 6441 - protein, 66 aa, Lactobacillus casei; identical to SEQ ID NO: 2798

SEQ ID NO: 6442 - protein, 277 aa, Lactobacillus casei
MSKPIDAVAVENISKILGEYTTGPKITKMFSLLGFFDYDLQRQTDNQWFKASTKWRRLDEIIRHECNASHNSRPFFRAIQYIARPQDFISKPEEWGRLRYEINECLIFYGYCLDDSGRIASAKTATTFSEAQLRLKTLSARLTELNVHPLVMKFCNEQFLQGDYFHAIFEASKGVVNRIQQLSGIQKDGNSLVSTVFSDKQPILVIKGNMLATETDRDIYSGLRNLLRTVIFLYRNPKAHTPKIYDPSSVDDAVQAFVIMSAAQTMLDSVVNVRDFL

SEQ ID NO: 6443 - protein, 246 aa, Lactobacillus casei
LNEPQPIEQNGQRVLTTEQLAELYGTTVGVVQMNFKRNSNKFIEGKHFFKLEGEQLRAFKNEPTNCGFVGKNASALYLWTRRCAARHSKMLGTDQAWDMFDSLEENYFNPKTRLPQTPEEKLALTMEVATRTVKRIEKLDGRVTDLEEKALLAPGEYNYISKQVNRAVANYLDVHHCKLNAKQRSLFYRDINHGLNDYIGIKIRTQLRKKDFDKADDFIQNWTPSTATLMKAREISLLEDQQQEAI

SEQ ID NO: 6444 - protein, 59 aa, Lactobacillus casei
MNERPKEKLTNVVKVQDKDVEDQVTGMVIDLLKQKGFTFANFESVVARVKSHYQNNATI

SEQ ID NO: 6445 - protein, 83 aa, Lactobacillus casei
MVQVPYYDNPGGALAVTVELPHAANVYLVDHANFNAHQRGDHFTYFGGHYDESPVTIRVSGAGRWYLIAENGSGEQYRYTWSK

SEQ ID NO: 6446 - protein, 118 aa, Lactobacillus casei
MPLLQVVEDDQISSKKYLAVEEEELAKMIEENQELKRKLAARGMWTLTTATSYVEGHNNTWVVNNILNVPRFHKFLQDTVVSYPPPGKKGYLFHPKPWLDFLDKWFSEISRSLREKGK

SEQ ID NO: 6447 - protein, 30 aa, Lactobacillus casei; identical to SEQ ID NO: 2793

SEQ ID NO: 6448 - protein, 67 aa, Lactobacillus casei; identical to SEQ ID NO: 2792

SEQ ID NO: 6449 - protein, 181 aa, Lactobacillus casei; identical to SEQ ID NO: 2791

SEQ ID NO: 6450 - protein, 104 aa, Lactobacillus casei
MAREIGKQLDRLESLAYKVRTDQYLLDYLREWAETKCDLFRDDDPHMTDGEKIQDRLFLKDNFKKYMDILGQTSLDMIKFEADLMDVRQNIADQCFHEGGVDHE

SEQ ID NO: 6451 - protein, 248 aa, Lactobacillus casei; identical to SEQ ID NO: 2789

SEQ ID NO: 6452 - protein, 274 aa, Lactobacillus casei
MSNLETNQGRLAAIETFAERCPDCGSLLYRPKGLSKVTGKKMAGVCMNCGYKQPPTEPKNVTPDMEKEARKNRTVGYYLAYSVFSTDAIIAKDFNNFHTDGSLGQQQLKLFAVGLSNKICRNEVVHALIIGDTGVGKSHIANGILIDTQAKTGYRKTCLFIDWNALMQRLKSGMSANAQDVRMKNEKIMHEIGKADVVVIDDLGSERGSDFDRQTADDVFRMREDKATIVTTNLHGQDLNKRYGERTMSRMAKHGQGNSFGVKGILDQRKEALP

SEQ ID NO: 6453 - protein, 172 aa, Lactobacillus casei
MKEYVIMDTEFNSTSNRAIQISAVRIRDGLHIADQFNRFIPSPDKFDQLHIIRTSNMRYSDYLALPSLQQTVRDYVAWMRTTIDIVGWSIEGDAGRIRETFKKGSHGIPKNWKFIDIADIVEKRYSFNATPPLQGLANVLGIPVNRTHNALDDCLRTFGVIKALESRDGKLF

SEQ ID NO: 6454 - protein, 140 aa, Lactobacillus casei
MDKLNLNLNELADGAIKEKLTKALAQVANNILDPNTDQSKARKVTIALNFKPDDSGVVKLTTDVKTTLVPDISVTTNVLLGRGEDGYMEMNELKSGTRGQEYFDPDDSTLKDDKGIPIKDDKVTDAPIDFRKIKNAKEAN

SEQ ID NO: 6455 - protein, 245 aa, Lactobacillus casei
MTTEADALKFTAEQAVTANGKRIIETKNRQFLINGNGDIREFRPNDGANEALQVHTLTAVVDYIGKVSERSASPLIVQVVDENSVFVLGELDDFGNREVLIKAKAMHPCYPYGQWLDSESFIIALQAQFMTTEDGKVLLKFVGNLKDESAQTMVDDGVSQVATARSGVASVGKVVVPNPISLRPYRTFLEVEQQESDFVFRMHEGPKLALFSADGDAWRNTAIDLVAEYLSEKLVKFSKHVTVLA

SEQ ID NO: 6456 - protein, 95 aa, Lactobacillus casei; identical to SEQ ID NO: 2784

SEQ ID NO: 6457 - protein, 110 aa, Lactobacillus casei
MNSLLIKLLICAVITVVICAYFFWLLFDHFVSNRRSKTVQIGSTVFIVRIGKKQYVSYFSKCSKEFKTSSEIDSSKLFVLRHDAEAAAEVSGGIVLTLPINIDDPNELKY

SEQ ID NO: 6458 - protein, 147 aa, Lactobacillus casei; identical to SEQ ID NO: 3164

SEQ ID NO: 6459 - protein, 217 aa, Lactobacillus casei
MSFISGFLTKDFCSIVADRRMSQGAKTVGENYKKFMLAESNILIATTGNAQVADIIKDFIKRLHVQSNGAQLNWQLYVNVIQQFVKETLKEAKDIDGNCVNQIVVICGVNGNKIMALAFGQTDAGYIQREYLPEENEQKFFTMTPPGVNPDAVTKEFISITNKIEIRTYSDIVIVQSKLQDYVAEIDSGKSVNTHKMGMGARIDGINGRFKEWSSGN

SEQ ID NO: 6460 - protein, 281 aa, Lactobacillus casei
MSPYTHLTLKDRESILLGISTGKTLDTIAKEIGRSKSTVSREIARNGGWRSYSAATAQDRYRRVRLASRRPRILDRPGTRDAVIRYITVLHWSPEQIAGRLSLEGSPIRISYSTIYRCIYLDNLGVPLKSHGARGLPRLLRHRGKTRKIKGTINERRGRFNDVPSIHDRPRSAENRSWFGHWEGDTVRGKTGHSALVTLVDRKSRYLLSKRTANAKADTVRDVMIELLGALPANRVRTVTPDRGREFARYRELAERLNTKVFFPDPHAPQQRGTNENTRTD

SEQ ID NO: 6461 - protein, 72 aa, Lactobacillus casei; identical to SEQ ID NO: 3325

SEQ ID NO: 6462 - protein, 39 aa, Lactobacillus casei; identical to SEQ ID NO: 3326

SEQ ID NO: 6463 - protein, 324 aa, Lactobacillus casei
MQWTDEQIGDIRKLASEGFTRRETADKLGISYDALQGKARRLGIEFQKPLKNEYDSDGTNRETPSADRKVALNADGSQTVTALMRLKHEPNKDPRTLMELCGYDPDKFEMVLGDYKVYEQHSTEDGTVPQYSIHIRVKPKQGLSINEMAEAFNDKIIPVNYGMKKSGDRNLVIPLPDLHFGWTTFADLKDMVSQLREIIMDGYNEIVIEQLGDLFHSDQIHVTQTVRGTQLDHANMRQAFHDAVKLFDQIIPLAIEYSNHVSIKSVFGNHSGDLEYAFLYALIDRYPQVHVDLNDSNLATDWRCAYLLGHVGIMLAHGDVAKNN

SEQ ID NO: 6464 - protein, 111 aa, Lactobacillus casei; identical to SEQ ID NO: 3208

SEQ ID NO: 6465 - protein, 304 aa, Lactobacillus casei
VHSYIWYGVGASSQLGLEALDRYMPRIKAQTPKGSIVALDYEDGASGNMAANTDAILAGMRRIRSEGYTPMYYSYKPYTLAHVDYQRILKEFPNSLWIAAYRDYLPTTKPDYGYFPSMDGVAIWQYTSAFGLSQGLDGNIDLLGVTDNGYSKQPVTPITPAPSKPAQSTAATDTDYAQTGVFKPSTTVNIRTGAGTGYASVGSYAPGESVIYDHVYIRGTYVWARYLSYSGRYHYVALGVNGGESYGSRSSNAQTYSHTYYTVRSGDSFWSIANKYGISMYTLAANNGKSIYSLIYPGESLYIR

SEQ ID NO: 6466 - protein, 261 aa, Lactobacillus casei
MQPVLLATVHHPNVSLPQLQQVVASVGKIFSAIYVTISSVTTNEIARLLDEAPKFHCRIIEPHGAADARRKVLEFGLRDVHDVAPFFYCDFDKVVVAVERAEPALEAFMKRLQAVDGYQIVGRDSVVMRSYPATWRETEAITNKAASAVLGLPDLDITAGCCAFSQEAARYILANSKGLLTDTEWPLICKAAKLTITAIKVSFLPYDQAVNAGRNDDNWRGYASRLRLAYQALQSLEQGVDRLDQTDTPKQVKVGWPYNGH

SEQ ID NO: 6467 - protein, 379 aa, Lactobacillus casei
MTQFNTKLVHGPQLQTDQAGAIVPPLYQSAMFRFAPDGQETHWDYARSGNPTREYLERQIATLENGDAGFAFSSGVAAIATVLAIFPNGSHFIIGDSLYSGTDRLINQYFAQHGLTFTAVDTRDLAAVEAAIRPETKAIFFETFSNPLLKVSSVKAISALAKAHSLITIVDNTFLTPYYQRPLDLGADIVLHSATKYLGGHGDLIAGLVVSAHPDLSEKLALLQNTIGAILSPLDCSLVSRGIATLAVRLDRETANAQAVAEFLNQHPDVAHVYYPGLPSDPGYALAQQETTGASGLLSIKLADNIDPLKFVNSTKVFDFADSLGTVSSLVKLPWFKLPEEKRADSGLTPQHVRIAIGLEDQQDLIDDLAQALVAAEKK

SEQ ID NO: 6468 - protein, 271 aa, Lactobacillus casei
MMLKKKLWFMLPIMALVAFTLTACSSGSSSTSKSSDVKSELINKNELTIGLEGTYAPFSYRKDGKLQGFEVELGKALAKKVGVKAKFVPTQWDSLIAGLGSQKFDLVLNNIAETPQRKKVYAFTTPYMYSRYALITRSDDTSIKQLSDIKGKKFVEGTGTPNAALAKKYGATITPSGDFTVSLNLVKEKRADGTINSSAAWYAYAKSNSTAGLKSQTLKVSAAKPDDIAGMVSKKSPKLQAALSKGIKELRKDGTLKKLSQKYFGADLTTK

SEQ ID NO: 6469 - protein, 237 aa, Lactobacillus casei
MWKIIADAVPQMVAAGIKYTIPIAIVSFAIGLIIALITALTRISARKGVLISIAKGVASFYVWLFRSTPLLVQLFIVFFGLPSLVIPGIFPHGIKLDPVVAGIITFSLNTGAYCAETIRAALLSIDSGQWEAAYAVGLPRRLVLREIIIPQALRTAVPPLSNSFISLVKDTSLAASITIVEMFQVSQQIAAENYQPLLMYSLVALLYAIVCTVLSWGQRYLEKVTSRYTANTQSTQL

SEQ ID NO: 6470 - protein, 66 aa, Lactobacillus casei
MMMYPYINLGPRDGVLLIAAIMLLVLTLVFKWSVFEFVLSAIAVIIAFLAGSMKSDKKNVLTFIKK

SEQ ID NO: 6471 - protein, 229 aa, Lactobacillus casei
MRKPKNKAILILTSPLFWIIGICSGMIYLEFFSSSISVFLAANCGNSPTEVLSGQYYRLFTALFLHQDIFHFAGNMIPLALLTWIISASITRLQYLMVLFFSGVIGNLLADIFITRLYKLNGHIWSFLTTFGYTDGSIGMSTAIEGLFFFATIVFLLTNLGRFSKVKFKLGLLVLVILSQILGAYQNLSTNPWLDLASYTHFGGGLTGALLAIIFLYRHHLKAKPTIDD

SEQ ID NO: 6472 - protein, 229 aa, Lactobacillus casei
MKQAIQLMRRIILSPLFWIVLFCSSITYIEESSSFNAFLISNFATNVPALVLSGQYYRLLSSLFLHTGISHLISNMILLVVLTWIISPIIGKGLYLIVLFLSGIFGNLLADLFITFLNNSNGNYWEFLTTIGYSYGIVGFSTSITGLFTFTFLTFAFIGTKDVPKRIFRLVALTLVSFIGFLSVILGFIAGQWFTLTAYVHFGGGLVGGILGILYLYFSKRKLTSRSTP

SEQ ID NO: 6473 - protein, 234 aa, Lactobacillus casei
MTKKTVANPALLILVIAWLVFGLTTRLNDFNEFSIANFTNVPNITMSSPIQWYRALTCLFLSNYGFPELISNSIMLIVLSLVTRKVTTYSEFLIIFIISGMVGNLLANTFIIYLVNSQMTIPSYLTSDGANGYVVGMSTALFGLLFYTLVRYIITQKDRVKSKADLFNLTFWLFVGLIPWAYPFLGGDPFNLSDYSHIAGSVVGLLLGLVATIAARLHGSTAPKESSLGAHGAP

SEQ ID NO: 6474 - protein, 304 aa, Lactobacillus casei
MKKAWVYGLAAMLGLGVSTVIGNQALTFAASAPPVAVQASAPSCSSTQPKEDSVKTTEDATEKTTDDQQPVITVADTDEPTDSKEASKSSVVTSDSQDDKKSSTSTEAISGGSVPSSKVSETSADKPSKVSEKTVSSTPTIKTEQEVNSLASQSVTKPTAEEQKEQAVVAVAQAATHDDVKVDHAVPVASSDGNYFKPSTSNRKHPRTAVELIWQALIDTFSQRQQCPSNISDRLVVHEPTDDQGIVKTSLALMTKELHKTFSVKELAQNFQKDILTPANRTIKDVIGLLNQVLLKHLINADYR

SEQ ID NO: 6475 - protein, 462 aa, Lactobacillus casei
MELPEKKLSTRDYVVIASLLFGLFFGAGNLIFPLHLGQLAGANWFPAMLGFLVTAVALPLLGVLAIAATHAEGVYDIGRPLGGVFALVFMVLIHATIGPMFGTPRTATVSFTTGVLPMLPKDWQQGGLLVFSALFFGAAFFLSYKERKITTAVGKVLNPIFLVLLFFVFFVGYLHPMGNPAAQTVTAAYKNGSFMNGFLQGYNTMDALAALAFGVTVVTAVRGLGLKNDDHVAKATAKAGVMATSFIGLIYVALIVLGSMSLAHFKLSPEGGTAFNQVVTYYFGTAGHAVLATLLTLTCLTTAVGLVAAFAQDFHRHFPKVSYRAWLALTSFLSFLTANFGLEQIIAWSVPMLMFLYPFSMVLILMSVFGKAFHHDPVVYRVVVAFTAVPAVLDMFAAFPAVVSQSAVGLALHSFQLHYLPFAAMGLGWLVPAAVGLVIGLVAHTVKTRRATALAKVQAEQN

SEQ ID NO: 6476 - protein, 222 aa, Lactobacillus casei
MRKINYIVTGISALTLAGCLVPTGSVFAANDTKTSVAEVNILPGDINLDKVPDLHFGTINIGQITAGNVDLKLDNNTIDATGPVKDGTNAMDGNADGELTVSDNRGTSAGWALTAQLGDMKDSAGRTLNGSLTLKTADVTTDNPTLNAVNPTAGTTLDFGGGSLPIWKADALATGTNGQGQGKNTALLKKGSETVLHLLKDPTASAGRYQAAITWTLADAPL

SEQ ID NO: 6477 - protein, 341 aa, Lactobacillus casei
MKRKILFGLIALLGMFWLGNLHQVQAAEGAGFTISPALPQNQIDKSTYFNLLVKPGETQRLLIYVKNTSDQAKKLKVSPVSAFTQNNGTLGYYPNNKKDNSAEYTFAQLASEPQTIDVPANGQVPVTFDVKIPEQGFTGQILGSLYVEDPNVHKSGGGGMAINNKFAMLIGVVLQTSETEVAPDLKLMQVKPGLQDNQAGVLATIQNFKPRLFGDMTLDGKVYRQGSNEPYLTRHEKGWSFAPNSHFDYAIFTKEALAPGTYTLDLTAKAVGKTWHWRRNFTITRQQSNAIEEKLGRTPQKTPWVWIIIAIILAVVILILLWLIWRQRQERGRETDGEKKA

SEQ ID NO: 6478 - protein, 154 aa, Lactobacillus casei
MAKRKRNFWFLMLMMVGLTAGGAAAHKVHAETSVAQVELVGELPSTGPDPTPPPTPKPDPKPDPGTDPSGKPSGGDPSDTTDPTDPAGATDPSNAGDPHGDQYGKGRSILDYSRLPQTGDAVQPWLIVIGVEVLLIVILSAVLVHGRSRQGGKK

SEQ ID NO: 6479 - protein, 659 aa, Lactobacillus casei
MKKKTLIMICLAAVFSVMLGPIQSAAAAATWPVPSTYPSPGEGNFTSLNGVFSPVSTQSHMISNGPDEVGLELNANIASQTGSIWSNHPFVDLDKSSFKLDMRIYLGNTTSGADGLAFALAGDRPTKVLSGGASLGIWGITGKNGGKPIDIATTGLPNSFAIVVDTKRSRDGLIVTTGMDQRVSYPWPSSSDQYIGSGYPGQASMYAIGYPNYKTELEFNNPEFPNEAKVLSGKITNGLWQDLSVEWHKTATGGNLIYRLSGTGFNTVTRSLTWTNQQINDIFGYKRQLYLGFTSATGDAFEPHVVAIKSLADFITVKPEVTLKREGQVVGETTILQPGDQLTYDYNLNVDNLDGSPWPMPTITLPKGEYFDYLKADGKPAQPGDELEVTLTVDGVAGPKVKAIVQADQKSAVITNMPELPKNKNTTVTFSLPAQVKLYNLSANQAFSDDAGTINGGSPAKDYKLINTADSSNKIKYVLGAHTGDLFLTHVPGFVFKKYTGGFSDPTVADIIRGIPGDNSLPSSPEDFKKWLNTLEGGGTEDYLEVLDTRPDQPGWHLQMKLSPFKLDGGDYVLGDNGSQTGGKAEIVLIDSNGTSEVARVKDNNDTVTVKNMPSGGGTWQIGDGAQHAQALMTVKGTPSVRAGKYHATATWTLADAPE

SEQ ID NO: 6480 - protein, 38 aa, Lactobacillus casei
MKKHVTRSHLLPVVVLGTLAFLLELPIHVLIASFTGFL

SEQ ID NO: 6481 - protein, 324 aa, Lactobacillus casei
MPRTEAHLTNDSNRKIKGVTFAVVGAIFWGASGIFTQTLFTNAGVKPLWLVGIRLFFAGMLLVLWSALRDPQSFLALWKNRRDAGLMILFAFFGMVPSQLTYFLAINAGNAATATILQFLGPVFILLYMALTTRQMPRRIDFISITLALIGTYLLVTRGHLTSLQLAPAAIFWGIMAGVSQALYTLLPRTLLAKYDARAVTGWSMLLGSLPFLPQYVLHPNPMLTLPDLGAIGFVVIFGTMLAYLLVLGSLNYISPVATGMLSAFEPLTATTLAVTRLHIAFGPAEWLGGLLIVLNTLLQALPFKKIQSVQKRLIHQLLQKSKS

SEQ ID NO: 6482 - protein, 575 aa, Lactobacillus casei
MKMLKKPTPDVSETTDSAALPLPKAFGWLTRLRPTLEKRGIQFDQLRLILASKGLLAARETNGLGSMFRSNRRRKETRLKNAFLWNALVGAILGLVLLIPTSILTTFTMFMTIQLLNSFLVILTTYSSLILDPRDRTVFAARGVNDRTLSFARLLNICYYLGMTLLAVGGPGIIISGLHYGPVVALGGLIALVFSGVLSLMMALFVYLLVLRFFDGERLRNMLNLVQILLMIGIYVGSQLPNILPRSMSFFGLSLSDSFNWIFIPAFPSWFAGLPMLFAGQVTALSMTLAGLSIVMPIVLTLVFLHFSGSFETYLEKLNQGNDRTRKLGWWFRGISALMTRPGEERTYFTLGWRVLGNERDYKLRVYPQLAYGLILPLVIVSNELRQMSFTNASHYVAYAGIGIVVALAPALVNLRFSSQPQAMAIFQYVPFTTHGLLLRGVVKAMFARLFLLPLVLITIVTTAIGGLDAFLAGVAIIVLIYGITLIMGWPLVGGQFPFASVYSANANVHGGSIGMISIIGGMIIGAIVIFVGGFLSGWIFPLALTLLGLTFGLLLGHFYRTNLHYELRINTEPE

SEQ ID NO: 6483 - protein, 264 aa, Lactobacillus casei
MTEPIVTLSHIRKSFGPKEVLKDLNFSITPGSIVGYIGPNGAGKSTTVKMMLGLLEPDDGTLELFGQPISPKDPSYKRRIGYVPESADVFDALTAREYLSLIGQLYGLSATDAEQKAFALAELVNLRDAFDRRISSYSKGMRQLILIIASLLHNPDILFWDEPLNGLDANTVLVIEEVLQDLRDQGKTIFYSSHILDVVQKLSDRIIVLNAGTVVADGPFKAIAKEADTNLQQLFNDLTGFAEHGQKAQSFVDIVTGGDSHEDA

SEQ ID NO: 6484 - protein, 182 aa, Lactobacillus casei
MQTSHNTLKNIIFTGLFAAIIYIGISLLRIPIPAMVGRPFIHFGNPLMVLAILFLGGRLGGLAAAIGLGGFDLLNGYAATSWLTVLEAIVMAIVVSALVKAFKHDDQPRNIIIIGIVAGLTKIVTSYLTGIVEALMVGTIFKTAIVGAFLSLPATVINSIATAFIVPILYFILRPLFKRFTS

SEQ ID NO: 6485 - protein, 274 aa, Lactobacillus casei
LNTKSLIISQDLCGVGQVSMGVALPLAAGLGLTPYVLPTALLSSHTGGLGANTYLDLSSEMSGILTHWQRLQLQPDGIYLGYLGQNAALQWQRWLPKFSAPLVLIDPVMADDGKLYKGFDAAYVETLQQLAYRATVLTPNVTEAQLLLDEPLVALTEPSAVMALAKRLHAQFHNAVLITGVPFHKQIAVVGIDASGETLALAQPKEPGHYFGTGDLFAAALATGLLKGQRLRQAAATAMVAARLAIKATLAADADPKYGLNLAGVIPALSKQLP

SEQ ID NO: 6486 - protein, 290 aa, Lactobacillus casei
MKINQCFKDHQVISFEVFPPRKNASNVALTPILNTLDAVKEADPDFVSVTFGANGNKPHMGTLEVAKLIKDEFDLEPVAHLPAAQLTRAQVDAELRGFQEAGIDNILALRGDIPKSGRVSNDFPYACDLIEHIHQRGDFNVVAACYPEKHPESPDVVSDIRHLKEKVDAGASQLISQLFFDNQVFYRFRERTELAGIHVPIEAGIMPVINEHQIERMATMAGVNLPPKFVAMMQHFSGNKEAMRDAGIAYAIDQIIDLLVHGVDGIHIYTMDNPTVVKRIATATKTIRNA

SEQ ID NO: 6487 - protein, 761 aa, Lactobacillus casei
MTTTIIGYPRIGEHRELKFATQKYFKHQITAQELQEKAKALRQQHWETIQAAGIDQIPTGDFSFFDNTLDVANLLNIVPKRYLDLNLSPLDTYFAQARGYQGDAGDVKALAMKKWFNTNYHYLVPEFDHDTHIQVTDWQLFEQYQEAKDLGIAARPTLIGPYTLLKLSRFIDVTPDDFVADLIAAYSTVIQRLHAAGAEWIQLDEPALVYDQTDADLALFERLYTPILAQKNTAKILVQTYFGDLTDSFEQISELPFDGFGLDFVEGYANLDLLKKHGFPAHVTLFAGIVNGKNIWRTHYADALATIKQLSTITDKLVLSTSTSLLHVPYTLRNETHLKPEEKQYLAFAEEKLNELHELDAIFHTGADHEAYQANVALFSKPRYEENKALNAKIAALTPEDYKRTPDRKTRLAIQAKEFNLPLLPTTTIGSFPQTAEVRRNRAKFRRHEITEAEYTAFNHQEEVDWIRFQEKIGLDVLVHGEFERNDMVEYFGENFGGFRFTDNGWVQSYGTRGVKPPIIWGDVVRTKPITVAETVFAQSQTDHLVKGMLTGPVTIYNWSFPREDLSQKTSVEQIALALEDEVLDLEKHGIKIIQIDEPALRENLPLRKKDWYPKYLDWAVPAFRLVASKVKPETQIHTHMCYSQFGDIIKAIDNLDADVISFEAARSDFSLLDILKATHFQTHVGPGVYDIHSPRIPSKDEIVHIIHEILKRLPADHVWINPDCGLKTRDVPETKASLINMVAAAKQVRKELTHENQPVL

SEQ ID NO: 6488 - protein, 572 aa, Lactobacillus casei
MKVLVPYIKKYRWDVIWSILAIFVVAFATLWQPHLLQVIMNAIMKNDKQTVWTNGLYLIGLAVIGIVGGIINTIYSARVALGVATDLRADEYAKIQSLAYADIEKFSPSNLVVRMTNDINQVQQIVMGFFQQVTRIPILFVGAVILAIVTLPELWWVIAVMMVLLLGVSLFSFSRMGKYFGRMQQLIEKVNTLARENLMGMRVVKSFVQGANQTKNFAESSDEMRDVSVKIGNLFALLMPAFFLIANLAIALSIWLIGQNITSHPSNLAAITSFINYLMQILFAIINGSFMLTFASRALVSLRRIHEVMDTKPSMTFVSGPHRDLDGGVEFNDVTFTYPGDEKPTIRDISFAVKPGEMIGIVGATGSGKTTLAQLIPRLFDPDTGIVKVGGHDVRAVTEADLRQTVGFVLQRSTLFSGTIAENLQQGNPDADLASMKWAARIAQSAEFIERLPHTYHAEVEERSSNFSGGQKQRLSITRGVIGQPKILILDDATSALDARSEKLVQEALAHELKNTTTIIIAEKISSIIKADRILVLDEGRLVGSGTHHELAQHNDVYREIYATQKALEEGV

SEQ ID NO: 6489 - protein, 593 aa, Lactobacillus casei
MKDLKNAGKFYAHYLRPYWLEFLITTILIAISTWAIVVAPTYMGRAIEELTVYVQQWANPATRGQASFTAFNHTLAIFVLLYLIDASSILISSLLLSKVSGYSTGTMRVGLFRKMQRMKVQYFDSHSDGDILSRFTSDLDNIFNAMNQALIEIFLSGAQFIGIIWMMFTQNATLAWITMASTPVAIGLAAFVMHQASVSVDRQQDDIGRLNGYINEQITGQKMLITNGLQQESVAGFQPYNNAVRKSNLRGQIWSGILNPLLMGLSLLNTAIVIFAGSWLALNGSLSQGAALALVVVFVNYAQQYYQPIVQLTSLFNMIQLAITGARRITEVREQPDEVDPKNGRTLDGLKHELVIDNVHFSYIPGKEILHGVTIHVEKGEMVALVGPTGSGKTTVMNLMNRFYDVDSGSITFDGVDVREFKLASLRQNVGIVLQDPQLFSGTIRDNIRFGDPEADQARVEAAAKQANIHDFIVSLPDGYDTLVSDEQSVFSAGQKQLMSIARTILTDPRLLILDEATSNVDTVTEAKIQAAMDNVIQGRTSFVIAHRLKTILNADKIVVLRDGRIIEEGNHEQLLAQNGFYAELYHNQMVFE

SEQ ID NO: 6490 - protein, 409 aa, Lactobacillus casei
MSKRRYLVALGGILLHLMIGSVYAWSVFTGPIAKQTGWALSSVTVAFSIAIFFLGMSAAFMGRVVERFGPRLTGTVAAILYGSGILLTGLAVQIDSLPLLYLGYGVIGGLGLGAGYVTPVSTIIAWFPDNRGLATGMAIMGFGFAAMLTGPVAQQLIAAIGLVATMYVLGAVYMVIMLGAAQVIRKPRPDEVPAADLAKSVSLTGKAMTASEAVKTPAFRYLWLMFFINITCGIGLVAVASPMAQQQTGMSAATAAMMVGVVGLFNGFGRLAWATLSDLIGRPLTYTLIFVVDVIMLVGILTVGSPLLFGIALCLIMSCYGAGFSVIPAYLGDVFGTKQLGAIHGYVLTAWAAAGIVGPTLLSFSEEYFHNYTVSLILFVLLELLALGLSIRIRREFKATAQDAKHVTD

SEQ ID NO: 6491 - protein, 238 aa, Lactobacillus casei
MRKYDVIYQDLKDKIEAEIYVTGSLLPSERTLQEMYQASRDTVRKALQLLKDDGFIQSQKGKGSTVINRQEYVFPVSGVVSYAELAKQFHLQTRTVILANHFATLPAKSFKDVDPHVTTKQMRFLKRVRYLKGEPDIIDIDYLDPKVVPPIPESAAKDSLYAYLEGQVGLTIAYATKEITVETATEEDRRYLKLPQAAVVVVVRSCSSLVDTTKFQYTESRHRADRFKFHDFARRMRP

SEQ ID NO: 6492 - protein, 550 aa, Lactobacillus casei
MGFHKKVIYQLYPKSFYDSNGDGVGDLRGIIDKIDYLKSLHVDMIWFNPFFVSPQYDNGYDVADYRNIDPRFGTMADFDELAKKLKEAGIDIMLDMVLNHTSTEHEWFQKALAGDKHYQAYYYIRPPKPDGSLPTNWESKFGGPAWAPFGDTGNYYLHLYERRQADLDWHNPAVRQEAAAIINFWRAKGVHGFRFDVLNVIGKAEKLVDAPPEVASKTLYTDTPIVQDYLKELAANSFRQDPNSVTVGEMSSTTVKNSIAYTKPENHELSMVFQFHHLKTDYKNGEKWTKEPYDFNALRDILHTWGQQLDQGGGWQALFWNNHDQPRALNRFGNVDKYRVKSAEMLAAAIHLSRGTPYIYMGEEIGMTDPHYHSMADYVDIEAKNAYKALLKEGKSEKEAFAIILAKARDNSRTPMQWDDSANAGFTTGTPWLRPTNQKDINVKDELAHGEIFEFYQKLIALRKEYDVISDGSYEPFGTDIDRLYAYERVAGADHLLVLNNFSDKAITVPLPNRFQSAKVLITNESGLIPTATMTLPPYATIALLTSEEN

SEQ ID NO: 6493 - protein, 683 aa, Lactobacillus casei
EIIBCACMPNENTMADEKKLHILAPVSGLAMAITDVSDPVFSQKMMGDGFGIEPSDGQIAAPVDGRIMMIADTKHAIGIKADDGAELLIHLGIDTVELKGAPFEIDTAMDAKVKAGDVIGSMDLDAIKKAGKKTTVIVAITNTNDVVDHLDVTPGEVKVGEEVAVMTPKAAAATSTTAATPNKKESKYAATARQIIADVGGAQNVNSLIHCITRLRFYLKDEQKPDDDTVRNIPGVIDVARANGQYQVVIGQAVTDVYDEVIKQLGPGYSNAEGTAEAIKKTQAEAKDTSFWGTIKRWTQALIGTITGSMIPVIGLLAASGMLKGVLNIMTTWFHLSTTDPTYVIINAMGDAAFYFLPVIVGFTAAQKLGSDPVIVGIIGAFLIYPSIAKIATAGKVSGTLLGMGVNASFFGLPVHIANYTYSIFPMIFAAWMAAKLEPWIKSWMPLVLRMIFTPLVEIFLVGMTVVLVVGPLITVLSGAITSGIQALLSLTPMISDAIIAGLYQVLVIFGLHWAVIPVITAQLSSAHPESVLNGIVSISMIAQGAGALAVWVKTKHNPALKGLSISAFISACCGITEPAMYGVNLKYGRVFVFASIGAAIGGVVNGLLGVSMYGFTGSFIGFPSFAAPGWAHNPGNFAGFWIASVVTLVAAFLLVYFFGYKDADANAAKAAPKKKRLGKTVE

SEQ ID NO: 6494 - protein, 430 aa, Lactobacillus casei
MYKRYKDVSLILKIVIGIVVGAVLGVLVPSWSFIDILGKLFVGALKAIAPLLVFLLIMSAISKYRSGSKNHFGTVIVLYLSATLLSSIAAVAVSYLFPIKLVLPGAMKIAESAPKDLGTVVSDLLTNAVANPISALVEGNYLAILFWSLLIGAGLRLASGTTKKAVTEFAETVSSVAQTVIQFAPFGIVGLLHESLSKTGVKGVMAYGQLLILLVATMVFVYLIVYPFMVWLLTHQNPYPLTFWTLKVSGIPAFFTRSGAVNIPINLQACEDLGLNKESYAISIPLGGSANSGGAAITVSIMTLATANTMGVHVSIFLALLLCFLSAISATGVSGIAGGSLLLIPMAASLFGISNDIAMQVVGIGFIIGVVQDSVETAVNSASDLLFTATAEYADDRRDGHPIDMRAAVRAAGKVKAKAAKPVEEEGEQI

SEQ ID NO: 6495 - protein, 492 aa, Lactobacillus casei
MGKVWQRLFRKEDPSVYEDKDSHLPRVLRVRDFLALGVGTIVSASIFTLPGVVAAKHAGPAVSISFLVAAIVAGLVAFAYAEMSAAMPFAGSAYSWINVVFGEFFGWIAGWALLAEYFIAVAFVASGLSANFRGLLATIGLNFPAALANPFGTDGGVVDLVAVVVMLMVGVLLSRGVSSAARVENILVVMKVLAILLFLVVGLTAIHPENFHPFFPKYHLNADGTPFGGWQGIYAGVSMIFLAYIGFDSIAANSAEAIDPEKTMPRGILGSLLIAVFLFVSVGLVLLGMFPYQDYANNAEPVGWALRHSGHAVVATVVESIAVLGMFTALIGMAMAGSRLLYSFGRDGMLPHGLGKLNSRKLPNIALAVLITIGVIIGAFFPFAFLAQLISAGTLIAFMFVTLGIYRLRPREGKDIAKPRFQMPLYPVLPAVAFLGSLVVFLGLDIQAKMYSGVWFLIGCAIYFLYGMRHSALTKGSVVEQETEALEQSKED

SEQ ID NO: 6496 - protein, 350 aa, Lactobacillus casei
LTLSSYGSQQTTQPERGLTLARVITTSHLRYTIVTDSGRYSAQVAGRLANMAIAPEDFPTVGDWVQVRLPDNSEDVAIIERLNERKTVFLRKSAGRKSDAQLVAANVDWLFLCMALDGNFNVRRMERYLAVAAASGAHFAIVLTKADKSIGFEDQLTAISEISGAHRIIVCDATTPDGLSELRAFMEPRETYAFLGSSGVGKTTLINHLLGSQKLETNAVRQSDAHGRHTTTSRQLMLLPNGSIVIDTPGMRELGLLDADVESAFADIQELSKHCRFNDCSHQKEPGCAVQQAVAEGKLSAIRVASYLSLQQEKSEHNDLRGRERENAKVKRMFGSKNQLKKFRRSVKKR

SEQ ID NO: 6497 - protein, 312 aa, Lactobacillus casei
MQNRGNIILIGDGAIGSSYAFNCLTTGVGQSLGIIDVNEKRVQGDVEDLSDALPYTSQKNIYAASYEDCKYADIIVITAGIAQKPGQTRLELLAINAKIMKEITHNIMASGFNGFILVASNPVDVLAELVLQESGLPRNQVLGSGTALDSARLRAEIGLRYNIDARIVHGYIMGEHGDSEFPVWDYTNIGGKPILDWIPKNRQESDLAEISERVKTAAYGIIEKKGATFYGIAASLTRLTSAFLNDDRAAFAMSVHLEGEYGLSGVSIGVPVILGANGLERIIELDLNAEDHKRLADSAAILKENLQKAQEA

SEQ ID NO: 6498 - protein, 64 aa, Lactobacillus casei
MTKAQPFLLEATYAPVSNRAGSRSKNSYHFAIFLLTLKQRPLRFLRKVVSHVSSILCAVSACNA

SEQ ID NO: 6499 - protein, 447 aa, Lactobacillus casei
MSAASYVQSVLATLKQRDPNQPEFFEAASTLLNTITPVFEKHPEYVKANILGQLVEPERAIQFAVPWQDDQGNIQVNRGFRVQFNSAIGPYKGGLRLHPSVNLSIVKFLGFEQIFKNSLTTLPIGGAKGGSDFDPKGKSDAEVMRFCQSFMTELSKYIGPDLDVPAGDIGVGAREIGYLYGQYKRLKGAQRGVLTGKGLSYGGSLARTEATGYGLIYYTDELLKANGETLTGKRAVISGAGNVAVHAAEKAEALGVKVLTVSDSNGYVVDENGIDVAVVKQIKEVERGRIKAYADRVAGAEYHEGSVWDATDLKFDLALPCATQNEIDGQQAARFKAAGVIAVAEGANMPSNPDAIAAYANAGILYGPAKAANAGGVAVSALEMGQNSRRESDSFEKVDSQLHEIMQHIFKASADAADEYGMPGNYEAGANIAGFLKVADAMYAQGM

SEQ ID NO: 6500 - protein, 99 aa, Lactobacillus casei
MTKSTLEKSVEELNQLLDGNDPGVERHERHLPTPPEFTGEEIKKIRQQIPATQLVFAQIMAASPRTVQAWETNRSKPNGPARRLMQLIELDPSVARLLM

SEQ ID NO: 6501 - protein, 172 aa, Lactobacillus casei
MIISLGNDHIVTYMKIKISNFLKHAGYQVIDEGTYDTVRTHYPIYGKKVAEDVADGRADLGIVLCGDGSGITMAANKNEGIRAAMVNDAAAAKYAREQLNANVLGFGGASIGEHLAYDIIKAYLDATYRETPENAELIKEIDHIAKPNPDQKDNPHFFDEENEKWAEGVYHD

SEQ ID NO: 6502 - protein, 142 aa, Lactobacillus casei
LDVVIGADQDGFAMKEQVKDYLKQRDYHVIDVTPQPAKNFVESALAVTKEVMAGKAHKGLMFDRYGVGSTMASTKVKGMVATNVGDETAAHQTAEHNGAKAIAIGTGLIGLDRALGLIQRYLDAEYVDGRHQVRLDMLAKMI

SEQ ID NO: 6503 - protein, 66 aa, Lactobacillus casei; identical to SEQ ID NO: 2746

SEQ ID NO: 6504 - protein, 143 aa, Lactobacillus casei
MIKQGNGQTTHHLGLVLCMWLGSIAFLATGVWATILLVLTSRITAALIITLIGGWVTLAGIFACVVTLWQLVRAPQAARHLVRRLQWLLGVITIIVAVISLSLSYAWAKSGDAPGIIFIGLFFAAMPFACWVLTSVWRLTLER

SEQ ID NO: 6505 - protein, 175 aa, Lactobacillus casei
MISETHCPQIKRFHGILTVKASKQERMDSMAERSLYHTYVRNENGLVGESYVEGNQGLALGVSSSLLDAPGTNPEQFIAFALSTCFNATIRIVQHREGTAEDSQLRTRVDIERDKIGYKFIVDAQILMPSHTREEAQKIVTQALDECPVAKLLKENENVSFRIVDEFTDEPTLGE

SEQ ID NO: 6506 - protein, 495 aa, Lactobacillus casei
MSTIQIKHLYFAYDGQAPLFSDAGFNLDTGWHLGLVGRNGRGKTTLLRLLQQQLDYRGTITVPVPLRYFPQALDESQLTLHAAQAFQDVAQWQLERELNLLHADPDILWRPFRDLSGGEQTKVRLALLFIQDDGFALIDEPTNHLDLRSRRQVAAYLKQKSGFIVVSHDRDFLDAVTDHTLAIERQKITLYQGNYTTFTTEKQRQDQTELAQNAQLKNEINRLKQTAHDKKVWAENKERSVYGNRHEKDSGHNNTRGFISARAARTMKKSKNLEHRMDKEIAAKEQLLKNLEKVDPLTMAPQPTHHHHLIVAENVQVGYDQPLFQPISFTLQPGDRVAIVGENGSGKSMLIRALLGHFTGNQTGLLTLAPVALSLVRQQYPDNRGLLPDFAEKRHLNLEILLNNLRKLGMPRADFATPIEHLSMGQQKKVEVARSLATPASLYIWDEPLNYLDTYNQDQIMAAITRYQPTMLFVEHDEHFINKIATKVVRLTPLT

SEQ ID NO: 6507 - protein, 207 aa, Lactobacillus casei
VKIFVVGAHGQIGQLLVHKLLDRGDTVTGGYRDPLTQTPDPQKNFRAVELNLAWPVSRLTELFAGHDAVIFAAGSRGKDLLGVDLDGAIKTMKAAEADDVGRFIMLSALDAEDPARWPEELHDYYIAKYYADEWLIHNTDLDYVIVQPTALTNDPAQGTITLQPQRPSTIPRADVADVLVAALDSNRHRETIKIASGNTPIAEAVKS

SEQ ID NO: 6508 - protein, 281 aa, Lactobacillus casei
MKTINIGDVTVPIVGMGTWYLGEGNAAQSARETEALKYGLDHGLNVIDTAEMYGNGAAESLIGGFLGDYNRSEIYLISKFYPSHADKKQMRTALTNSLSRLKTDYLDLYLLHWRGATPLAETLEGLQELKKEGLIRQYGVSNFDVDDMDQLTMEPGGDQVVANEVLYNLQSRGIEYDLLPRQKQAGITTIGYSPYGSGSGKSIKLTPELVDLAKAKGVSTHQLMLAWVLRNGDVLSIPRTGEASHMAENIAAADVTFTPDELALFDQAFPAPRHHIPLEII

SEQ ID NO: 6509 - protein, 454 aa, Lactobacillus casei
MQMIALGGTIGVGLFMGAGATIKWTGPSVLIAYIVAGLFLYLIMRALGEMLYVDPATGSFAKFASEYMHPLFGYLTAWSNIFQFVVVGMSEMIAIGEYFKFWWPGLPGWLPGLVAITFLVLANLISVRMFGELEFWFALIKVVTIILMIVAGLGVILFGLGNGGHPVGISNLWTHGGFFTGGFKGFCFALSIVLGSYQGVELIGITAGEAANPKPTIVKAVKDTIGRILIFYVGAIFVIVAIYPWDQLNTLGSPFVQTFAKIGITFAASLINFVVITAALSGSNSGIYSASRMLYTLADAKQLPRIFTKLNRHGVPFYPVVSVGAGILLGVILNALLPCVAPAAKNVFVLVYSSSVLPGMVPWVVILVSETRFRKVHADKMPDHPFKMPFAPYSNYLTLIFLAFALFFMLLNPETSISLLVGVIFLTLVCLHYFFHYRTGAKKLPPAEHDNDHR

SEQ ID NO: 6510 - protein, 734 aa, Lactobacillus casei
LDKDNKLKTSLNAYMAKHQLNTNATSVAIGVSVPTLRKALRGEKVSRKTTAKIESIIASGKVPAGAATSKTTKKTVAKKPAAKVATRKTAAKTPATPKAAAKRTSTGTVGRPAHSQANSTSASATNHSQSTTQSAANAQENAASAQPKRRTTTRVNRATVTARQNNRTNNQHQNQATNSEASTEQPTTNKRPSTRNHRFTIRQQPDVATQEAQAEAKKRQTQTNSQSAAASVKPAESDERHETTARHTKQHTPTGKTETFRRNGKSEREPVRNERRNVRTDRNKPNSTRHPGRPKQKRFAANADPQNWQPMTQSASTSASQSMTSQDATKQHVPAVVNKVETHTPSVIRSSSNERNGVNGATASSTSNNTSATNATSQRNQRASYGMHTEAPLVTGKQLQLFIDESFEERRPDPRMMHMGIAAVFPEGDDESLAGFRDALYPYGWEPGDEVKARGKQVDALTQLIKAAQHEHMGMYTVFSRKTTYPDFAPSMEYLYPYIGATIHVLRDVDTTFDSIVIMIDHRNELEGNQLVMGADIVSRYLTLSLERPIKVRFEFADSREHLGLQLSDFVANAALRLSHDELSLIGINPMPELGVSQHDQLVRLTLLGLQQVVMGVRAERAATPSKHSQPDRFMQLIFDATYADSDRVRGALPVVKNALEQLIDVLPNARVGQISGMPNQSWYDMTARMAGLLRYINKDPKPYGKVLAKIESVAKTAADELEMALDSDSKAKR

SEQ ID NO: 6511 - protein, 660 aa, Lactobacillus casei
LSQVVIFGIMLATVIVGNLLARHIPKIPLPFFLIGLGAALAVMPSLRNFAIDPSVFSFAIIAPLLFNEGQNASRLQIGRSLTNIVSLAVGLVLFSVIILGFSVHALFPVIPLSLAFALIAIVTPTDASAVSAVAQTNPLSDSQMQLLNNESLFNDAAGIVAFDLALSAYVSGRFSATDALLDFLFVFFGGILVGAIIGTLIVNLRAWLIRIGDDEPLIMVGIQLLTPLLVYFLAEELALSGILAVVAAGIAQGVERDRLRLTSARMQIISANVWEMIAAVLSGLVFVLLGLSLPNVVIEALRGQAGLFSLLVGIGVFIYAAKSLVRFFWSRTLLRIGKKNRWRNALIMMLGGANGTITLSLAFSMPRTINGHEFALRQGLILIAAVVILLSLIVPVVVLPFCVPKQPKRNRQYIWLRRMLSAGIDAMRDETEHHSEAQIVADALSQEMILNDNPSRRLQRSIFEGTITAEKTAIEALRANGTITQDEAHYYNRFIDLNDFTADQRLWKNLFLRIRFSFNMGRMYKAFNEAQNAFLTTPLNLEPIFWKRQFTAHGEDLLPIEQAGYDAVMKYLTHIENAQNRSAVNTIRRFYRDRHRRVHSDSFDGDILYAMFLKAFHAEYEFIQQAFADGKLSRDIMQRLQTRITFDEITYLKNQDSFIV

SEQ ID NO: 6512 - protein, 261 aa, Lactobacillus casei
MKRKQSKKRHHWLGKTVLVLFLLAAGGYWFWWQIGSRPIHARTYRNTNVVTVFIPGYGSNSLTFGPMVSRFQKDHATNQVTTIKISATGKRTVTGAKRYDGKNPLISVVFEDAKAPVKETRQLTALLHWLRTKHQVKRVNLVGHSMGSNLSFRYLTTQHTDVQPQVVKYISFASEFYRDPTSQLAHFPKSVQTLVIGSQIFGAKGDWAVSLAGVKRYEQELKAAGVPTSLYIYRGTPIGAYHSSLHQNPYIDAKILQFLFT

SEQ ID NO: 6513 - protein, 213 aa, Lactobacillus casei
MPPLDYHHQDTWPNGFGQQQSPIDLRDATAADPSTLTIEEPWLVDQEIDDHVTIRLAGHGLTQIDRTQWRFVQAHLHVPAEHRIANQRAAEWHFVHQSAIGALCVVAVLLPLGDGMPVMDSVLDHFVAQSSQPVALQLDSLLPPKGTVFRYLGSLTTPPLTEGVTWYVIDQTAVTISPQQRQRFQQLFPDNHRQLQARNDRPVLHGPFLQGSK

SEQ ID NO: 6514 - protein, 108 aa, Lactobacillus casei
VAQDILITTTENIPGKHYEIIGEVFGLTTQSKNVISNIGAGLKNIVGGEIKAYSNMLHESREKSIERLRDEVRKVGGDAVVMMRFDSGSIGGDMQSVVAYGTAVKLLD

SEQ ID NO: 6515 - protein, 110 aa, Lactobacillus casei
MAHTIAEVDAQHHHSLACGHTKLLHGDHVDYLENGHLHHPHEDHFDEAVIPVSATNPDGESPIVEGELHDQYCGHEQVPHGDHIDYLVNGRLQHVHGDHVDDHGPVDVVN

SEQ ID NO: 6516 - protein, 303 aa, Lactobacillus casei
MIGYGFSEAGGPEVIDAIELPTPQPGPREIQIKTEAIGLNNRDRIARQMGGSGLTVPGYDVAGVVSAIGSRVTQFSQGDRVIARTTSAYAEIVTAAADMSVLLPATITPETGVALITPGVTGYRMVELGKIKAGDTVIVKGASGGVGSAAIQLAVARGASVIGIAASRHEAEVNRLGVEHFVAYDRGNPVDELRKTADVVINAAMNGLGGDDDVEMAKDGGLIVSVSHTEPLLSRGVRFVHTRPLGGSEVGRALQTLVDLMAQDKLTVQVGYVLPFTREGFIKGHQLLDDPRHEGRIVIKVSK

SEQ ID NO: 6517 - protein, 438 aa, Lactobacillus casei
MNLADTGFVIIASVLVWFMTPGLAFFYGGLVSKRNVINTMLSVFYITGIAILLWVAVGYELSFNGNLFGVIGQVHHFFLSDISLGAVTAARIPTGVYILFQMMFAIITPALFVGAVVGRMHFKFLTCFIVLWSLLVYYPLVHLIWSPDGLLAGLGVLDFAGGTVIHINAGITALTLSAFLGRRTDEHTVPYNRPWVLLGTAILWIGWYGFNAGSALGVNQAAMTAALTTSVGAAAALVTWMCLDIWQTGHPTLIGTCTGALCGLVGITPATGYVTSFGAACIGVLATLASYWFISKIKPRLGIDDTLDAFGCHGVAGIVGSILTGVFASKQVAPNISHAGLAYNGGWHLLLIQLAGTLIVIVLVGAMVTIITVILSRFVSIRVSPAAEKMGLDYSEHAEPVDEEVAASWEHHTPVSSFPDEFKGQLHGFDPRPHQDDR

SEQ ID NO: 6518 - protein, 313 aa, Lactobacillus casei
MAIDLRDVQDVYKDAGSDIIFATFDLKRQDVASDKEMIADLADHLPAFINSLNIRYPDAKLATAFGFSRKAWDYLFPDAERPKELEAFQPIVGPKYTAVATPADLFFHIRSQNSAVPFELMSEIMEIIGNNTVTLDETHGFRYFEGRAIIGFVDGTENPSALDTPEYAVIGDEDPAFENGSYAFAQKYHHKLDAWNKLKTEDQEKAIGRKKFNDFELADEEKLVNSHNVVSQDNEGGVEHKIVRMNVPFSNPAEKINGTYFIGYARHWAVTKRMLQGMFDNSDRLLDFSTPLTGELFFIPSKSVLGQIADGEL

SEQ ID NO: 6519 - protein, 223 aa, Lactobacillus casei
LTMTIMDQVELVIRLLVAAFCGFAIGFERKNRFKNAGIRTHMIVALGSALIMIVSKYGFFDILNLKNIALDPSRVAAQIVSGVSFLGAGAILVRHNNVNGLTTAAGVWTTAAVGMAIGAKLYILGLSATALVLGIQVVLHHHYRWLPSGDNGVLTIRIRNEGFDMEHMRQTLGKYHIKVLNVSIKHEGDEVKMSLHVESRANEDMRRLLMFYADNPNIISIEF

SEQ ID NO: 6520 - protein, 547 aa, Lactobacillus casei
LLTVNNVSMTFSDRKLYEDVNLKFTPGNCYGIIGANGAGKSTFLKILEGELTPTTGSVSLSPNERMSSLKQDHFAFDDQTVMNTVLQGWERLYQVMTEKDALYAKADFSEADGNKAAELEGEFAEMDGWNAESDASQLLQSLGIRESEHQKLMADLPEGEKVKVLLAQALFGKPDVLLLDEPTNGLDPQAISWLEDFLADYEHTVLVVSHDRHFLNAVCTMMCDVDFGKIELYVGNYDFWKQSSELALQLQSQANAKKEEQIKQLQEFVARFSANASKSKQATSRKKQLEKITLDDIRPSSRKYPYIKFEPERAIGNDLLRVENVSKTIDGQQVLKDVSFILRPGDKTGIISRSDVTATVLMQLLAGELEPDSGTITWGVTTSRAAMPKDLNPEFDHADLNILDWLRQFAPQDEQDNTFLRGFLGRMLFSGDEVLKQLNVLSGGEKVRSYLAKMMLSKANVLIMDDPTNHLDLESITSLNDALIDFKGSVIFTSHDHQFIQTIADHIIEVGPLGVVDRADTSYDEFMQHETAQKQVEAIYPESLRQA

SEQ ID NO: 6521 - protein, 57 aa, Lactobacillus casei
MSLSGDIVVGGALFAPPTTRPSFKTQRFLLRLKVVPTTFQAQLAGDCGVWHVPEQIA

SEQ ID NO: 6522 - protein, 558 aa, Lactobacillus casei
MTQPVIILLGVGGFAVAVVVLNLLLAWRRQAKLKQQLLADWGTLPVKRGGSERYLKAAYLDHEAQVDHDCLIDDLTWRDLDMFEVFKQLNATQSSVGAERVYAQLRAYDLGKPDVNETLIDFFRTHAEERLKVQLAFAGLGTEAANNSQHYLRTTTQAALPHAWRFKVLGGLPVVGLLLISLLPAIGVALATLSLMVNLFYYVLKREALDAEVMAMGYLVRTIVTAEHLVKIAQPTQAALRTALKPMRGITRLAFVFRTRDNSSADMMTEYFSSMFMLGFIAYNNVLTRLHNRHAEALTLWQALGDLELAIAIANFREAHANSSQPVFADGGLTAKELVHPLLKHPVANPVDWQKNALITGANASGKSTYVKSIAVNAILAQTINTVLAKDMSIQPGLVITAMAIRDDLSEGDSYFVAEIKAIHRLLDAVATNKRIYGFIDEILKGTNTVERIAASASVINWLSHYPSLVVVATHDNELTDIMGEQCVNWHFQEKVTKKDGVVFDYLLHQGPATSHNAITLLATMAYPETLIKDARTLAADFERTKAWPRYRQGGIKA

SEQ ID NO: 6523 - protein, 193 aa, Lactobacillus casei
VTTANQIFEAIRRDPANADFTAQGWDPLYHIEPDATILIASQAPGRKAQTTKTYWNDPSGDRLRTWMGVTNDQFYHSGKIAVLPLDFYYPGKGKSGDLPPRKDFAAKWHPPLLALMPHIQLTIVIGAYAQKYYLGKRREKTLTATVKNFRAYLPTYFPIVHPSPLNYGWVNRNPWFMDEVVPALQERVARLMK

SEQ ID NO: 6524 - protein, 477 aa, Lactobacillus casei
MTTGLPKNFLWGGAVAAHQLEGAWQEDGKGVSVADVMTVGGPEKARTITDGVVPGEYYPNHDGIDFYHRYKEDIALFKEMGFNSFRTSIAWTRIYPNGDETQPNEAGLQFYDDLFDELLRNGIEPVVTLSHFELPYHLVTEYGGFRNRKLIEFFVRFATTCFERYKNKVKYWMTFNEINNQANFIDDFAPFTNSGLRYQPGDDREAIMYQAAHNELVASAEAVQIGHAINPTMQIGCMIAMGPIYPYSMNPEDVLLAQKAMEHNYFFADVHVHGDYPATLLKYWERKGITPEISAEDRQILKNGTVDYIGLSYYMSHAVKKDPARSFDDLDLKQVVKNNYLKASDWGWQIDPRGLRYALNWLTDRYRKPLFIVENGFGAYDKVEANGQIHDSYRINYLRAHIEQMKLAVTEDGVDLIGYLPWGPIDLVSAGTGEMDKRYGFIYVDKDNQGEGTLARSRKDSFFWYKQVIASNGENLN

SEQ ID NO: 6525 - protein, 89 aa, Lactobacillus casei
MMAKKTTDYFKAHSKDIQLDAVTATEGEDEIRNGDFDLFLISPQTNMYLDNFQKVGKEVGKPVVSIPFDAYIPIPMGIEKMAKLVEKNL

SEQ ID NO: 6526 - protein, 677 aa, Lactobacillus casei
ABCHPERNREGLATRMKQKERELLLYLVENQDQYVTSKDLANTLLMTPRTVRSYVKSLKAMIEKYGASLEAKPSFGYRLHILHPVAFDLFLNQHKVLSPKVNDTVTASESIDRQNYILNKLLIEDEALLMDDLAERLFVSRSTLSKDMISVREKLEPYALHLESRANKGFYVVGTERNRRHFILDYFFSHGQNNFQRFMENKSFFADVSFEQLTIVVIDECREASLRLSDFIIQNIVLYLALSIERVRKGNSLPPVKVEQAPEHQRHYAVAERIMERIARSTGLQFSESEVAYLAIQLVAMAKGSPQDSNDQALWKDMDQVLRRIEAETGYPVSTDYALRKSLAEHIKPMLVRLQQGIQLKNPLLKEIKTHYPQYFADTKRFLGMSKILSAYTINDDETAYMAMHLMAAVEKYHNAHKLRTLIICATGYGSAELLNNRVQKEFGETLNIVGVKGYYEVDDESLADVDLIISAIDLSTQVLRVPVIQVSVFLGEMDVRAIRQFLETHNRPHGKAASKVEAIAAVDKSIFDQFTDSSRFVRWTEPVNRETVLNRLCAQVALLEPANFADELKAQVHQREQMSSITFSQKIVVPHPAMPIGQFTQIAIGVIPAGLKWSESFPAVQLVFLLSPSYLGNRGLTSITQTIVALTDHADWQASLVAASDFKSFRHRFLQMMEEE

SEQ ID NO: 6527 - protein, 119 aa, Lactobacillus casei
MNSDDIQLIAFEIILHSGNSRTMIHEAFAAMRVGNFDKADERLKASNDELLLAHQSQSDLLKKYAGGTKIEMEIILVHAQDHLMTTMTLREVALEMEHLYRNQAAAGELKSNEPEDKGK

SEQ ID NO: 6528 - protein, 175 aa, Lactobacillus casei
MNRKIKASENVQTQTTTTIDKNRQALSLQSMRFNRFLGIRYLTAVFFFANLWWAIIANNLWSKWLPVGLIILAIPVIYEQIKLFGTPTHHLPYTTLYFWCQTWVNIGLSILIVTPLFNALYPFIRDTNNNRGVVLLILMIGIGLGVWSLRRLHLIRQDKDRFYSRLLAYQATLHK

SEQ ID NO: 6529 - protein, 453 aa, Lactobacillus casei
MENNGRFFNFMTKTLLKPMSKVAQYRIVRAVMAAGMASIPFTIVGSMVLVLNVIPLVWPVTAGFWNATFMKFSDLYMVINTATMGILAMYFALAIGYELTRIIQTEDKLKVAPLNGAFLSLFAFFMCLPELVVKGGKIILLNSITSKEKVINGFRMTATIDRLGTSGIFTAIIMAIVAVYLYKFCVKHNWTIRMPEAVPEGVSRSFTALIPTAVIALVVMVINGSLVLLGTDIFKMISIPFSFVTNLTSTWIGVIIIEFLIHALWIVGIHGANIISAFITPILLTNMAANAKGAHIPFAGEFNNSFAIMGGSGATLGLCLFIAFAARSEQLKVLGRASLAPAFFNINEPLIFGLPIVYNPYLAIPFFLAPMASASLAYAAFYFRLINPIITQAPWPSPIGFGALISTVDIRAVIVAILCGIVAFLIWFPFIKLYDAKLVNDEKQVAAGKEAEA

SEQ ID NO: 6530 - protein, 235 aa, Lactobacillus casei
MWTQALGEFIGTFVLILLGDGVVAGVSLNKSKANGAGWVAITLGWGLAVTMGVYTAAFLGPAHLNPAVTVAFAAIGRFPWAWVLPFIIAQLLGALLGAAAVWLHYYPHWAATKDPAATLGVFATGPAIRSYAANFISEFIGTAVLIFGLLAFTKGKWTDGLNPIGVGILITAIGLSLGGTTGYAINPARDLGPRLAHAILPIANKGDSDWPYAWVPVLGPLAGGVAGALIFAALP

SEQ ID NO: 6531 - protein, 617 aa, Lactobacillus casei
MAFSKETRKQTIEQLKQTELDLLVVGGGITGAGVAIQAAASGIKTGLIEMQDFAEGTSSRSTKLVHGGIRYLKTFDVGVVADTVKERAVVQGIAPHIPRPFPMLLPIFQEPGSTFDMFSIKIAMDLYDRLANVEGSQYANYTVTKDEILQREPQLEKDGLQGGGVYLDFVNNDARLVIENIKEAAELGGLMASRVKAIGVLHNDAGQVIGLRVKDLLDDSEFDIHAKLVINTTGPWSDKFKALDKNENQAPTLRPTKGVHLVVDGSRLPVPQPTYMDTGLNDGRMFFVVPREGKTYFGTTDTDYTGDFKHPRVEQADVDYLLKVINKRFPESHITIDDIEASWAGLRPLIANNGSSDYNGGGANTGKVSDDSFEALVKVVNDYEDNQATRSDVEHAISKLETAHAEASLSPSQISRGSSLRQADDGMITLSGGKITDYRKMAAGALALIRRVLAEKFATETRTVDSKKLQVSGGHFDPTNVDDTIAFYTRIGIDAGMPEKDAADLANRYGSNISRVVTYADGQPAPGLSLKETMSLRYSINEEMTLTPVDYLLRRTNAILFHAETLADLKQPVVDEMARILGWDEATKAQQLADLEQAISESRLDDLKKAPASAPQA

SEQ ID NO: 6532 - protein, 505 aa, Lactobacillus casei
VTNEQQYILAIDEGTTSTRTIIIDHNGQKVADAQREFPQYFPHPGWVEHNANEIWNAALSTIATAFIESHIQPRQIVGIGITNQRETTVVWDKQTGLPIYNAIVWQSRQTSEIADQLKADGYDDLIHDATGLLIDSYFSATKIRWILDHVPGAQERAEKGELLFGTIDTWLSWKLSGGAIHVTDYTNASRTMLFNIHKLDWDDEILRILNIPKQMLPEVRSNSEIYGDAAAYHFFGSTVPIAGMVGDQQAALFGQLAIQPGMVKNTYGTGAFIVMNTGDKPTLSNHNLLTTIGYGLDGKVTYALEGSVFVAGSAIQWLRDAMKMIERSSDSEAAALASKSQNEVYVVPAFTGLGAPYWDSDARGAIFGITRGTTREDFIKATLQSLAYQSRDVVDTMNADTGMPIPALRVDGGAANNDYLMQFQADILGIPIERAANLETTAMGAAFFAGLATGFWNNTDELQSIVKVGKRFEPQMDAVDRDYLYEGWKQAVAATQMYKHTKNHN

SEQ ID NO: 6533 - protein, 239 aa, Lactobacillus casei
MTNLDISIIVPTYNLGRYLPATLKTIQEQTIDVELWLIDDASSDRTAQTAADFVRGVPTYHATAFDRHRGIGAARNFGIDHANGRFIAFVDGDDLIAPTFAETLVRGFTPGVVATAVGYDWWHRSRGGPDRFRLLSQAEMFEQVSHHGTEIGGYIWNKAFSHAALDAGNIRYKEQLRIAEDYDFTAEYVAHTRGKYAYNPTVLYKKINRPNSTMHNFSWDDRRQEDKIFDHIYQLKQLI

SEQ ID NO: 6534 - protein, 388 aa, Lactobacillus casei
VNSTDVTKGFTEQFGKQAEHTFFAPGRINLIGEHTDYNGGHVFPCAISLGTYAAVGANEDNAFRLYSANFPKVGIIDIPFPDLFQEKRGLWTDYFQGMARVMKTAGINYTHGLNVYINGNLPDGAGLSSSASLEMLVGTILNNLFDGGFAPLDLVKFGVKVENDYIGVNSGIMDQFAIEMGRANQATLLDTNTMKYEYLPVEMGDNVIVIMNTNKRRELADSKYNERRSECEKALAMLQKGIDVKSLGQLTEDEFDENTYLIYDPILIKRARHAVFENQRTLTAAQALQKGDLTTFGKLVSASGVSLAFDYEVTGVELDTLVTNALKQRGVLGARMTGAGFGGCAIAIVNSADVEDFISNVGKAYTEKIGYDAHFYVADIADGAKQLN

SEQ ID NO: 6535 - protein, 331 aa, Lactobacillus casei
MTIAVLGGAGYIGSHTVKQLLADGEDVIVLDNLITGHRKAVDPRARFYQGDIRDYHFLSQVFSKEKIDGIVHFAAFSIVPESMKDPLKYFDNNTGGMITLLEAMNQFGIKKIVFSSTAATYGEPKQVPIKETDPQVPTNPYGESKLAMEKIMHWADIAYGLKFVALRYFNVAGAMPDGSIGEDHHPETHLIPIILQVAAGTRTGLQIYGDDYPTKDGTNVRDYVHVVDLADAHVLALNYLNAGNQSSAFNIGSAHGFSNLEILNAARKVTGQKIPATMAPRRAGDPSTLIASSDKARDILGWKPNYDDIDKIIETAWNWHENHPEGFGDRN

SEQ ID NO: 6536 - protein, 485 aa, Lactobacillus casei
LTAITNHIETIIKLNPDYTHMDAVYLTNKLLNLIGDAALDLPGDEDPLENLDLMVQAAQDNGKIPDSLSARQILEAQLMDFATPTPSRVNQMFWDKYQAGPRVATDWFFALSRANNYIQTRAIAKNLVFPAKTEYGDLEITVNLSKPEKDPKDIAAAAHAQSGYPACALCLQTEGYAGRSNFAARTNHRIIRFLLGGKTWGFQYSPYAYFNEHAIFLDAIHEPMVIDQSTFENLLAIVAMFPTYFVGSNADLPIVGGSMLAHEHYQGGRHTFPMAKAPIETQVEISGHPHVFAGIVKWPMSVIRLVSADREELVNAAEHVRQVWDQYTDESVDVRAFVDGKPHHTVTPIARRVGSEYQLDLVLRDNQTSKQYPDGIFHPHQDVQHIKKENIGLIEVMGRAILPARLKTELAEVQKYLLGEANDMKPMHKAWADQLKAKYQWTPENAEAQLQEAVGRVFARVLEDAGVFKRDEIGQEAFGRFCRTL

SEQ ID NO: 6537 - protein, 331 aa, Lactobacillus casei
MTTITDIAKAAGVSIATVSRILNYDATLAVTPETRQRVLKTAEKLAYKPRRRKRVPTQTTVALVQWRSEQEELNDLYYLQIQYAIEAKAAGVGYHLQNFHLEQLDSDSVTNIQGIIALGKYDAGEVAKMKALGLPVVFVDQNMLAFDCDSVTADYAGPIKEIIAHFRKVGIDDIGFLGGLETSRSGREQFQDVRTVTFDRVAKDAGFARPEFRLIGEFTPDSGYRLMKKAIETLGDQLPHGFIIANDTMAVGALRALNEAGLAVPQRVSVISFNDVAVAKFTTPPLSTVHAATDQMGQTAVELLQARLGDAKRVPRQVNFKSELVMRASSL

SEQ ID NO: 6538 - protein, 336 aa, Lactobacillus casei
MDVSVEQYGQYQGHDLYELTLTNDQGMVVKLLNYGATLEKVLLPEADGLHNMILSLPSREDYSKERNFLGGTVGRIVGRIRGHVWQHGDVKVDLPMNEGNNHIHGGDDGLDRQVYNFRIEKTATTASASFTFVDPDGHNGYPGNLKLQVTYTLTNTNALQYRVDALSDAETLFNPTNHTYFALDQPASIDDTTLTIPADDYKPLDAEHLPNQGWQPVSGTVFDFRHGQKLGDVIHTRADQITSERGINHPFLLKNGKTLAAKLQTAKHTMTLVTTAPSVVVYTANHFDGTGIPHNIKQFDGVALECQFAPVSGDDLSAITLLPGEPFTLANTWTFE

SEQ ID NO: 6539 - protein, 164 aa, Lactobacillus casei
MAANIVFTRIDNRLVHGQVGVTWTRAVNANLILVANDQAANDPLQQKLMATTADSSGAGIRFFTVQHTIDIIGKAADRQHIFIVIKTPADARKLVENGVPIKEVNVGNMHFAQGKTEITKKVYVDEQDKEDLLAIVNAGVNIFIQDYPGDKKTPITADLLKNVK

SEQ ID NO: 6540 - protein, 268 aa, Lactobacillus casei
MDVTLTQGVLIALWAMISGLDCWLQAFFIFRPIIVCTITGLILGDLQLGVIAGGLTELAFAGLTPAGGTQPPNTVLCGIMTVVIAATNKTAPATAIGLSLPFAMLMQYILLFFYSSFSLFLPKFDQYAAEGNTGAFKRLNFIPLTIVTLSFGIMAFLSAYAAQGPMKALVTSMPHWLTHGFELAGGILPAVGFAMLLKVMLKGQYFAYLLLGFVMASMIPFSNVLPVALVGAVFAMIEFYRSRDQIKLEKQVKEVENQSQGGGMNDGI

SEQ ID NO: 6541 - protein, 269 aa, Lactobacillus casei
MASDDKKQKKSLFTNHEISMLGIRSNLVQASFSYERMHSPGWTWAQLPYWQKIYKDDPKGLKAVMTDNMEFINSSPPLYPILMGLLLTMEEGHVDRTTIKGLKNALFGPMAGIGDAIFWFTIMPIVGGISASIAKNGNVFGPILFFLVYLFLFWSRIPLAHLGYNLGTRAIDVIQENSRIISHVASILGLTVIGGLIASYVKMSLTIKVGAGNTVINLQKQLLDKIFPNILPFAFVFLLYWLLKKNVNPIWLIVVTFALAIVMAAIGWM

SEQ ID NO: 6542 - protein, 142 aa, Lactobacillus casei
LSKVQVIVTGHGTFADGFKGALHLLASVPDNWSFVNFSEGMSDKQLQAKFETILGSDPKPTLFFTDLAGGTPYKVAATLASKNPQLAVVSGCNLGSLLESVFSDYDNADAYADAIIAASKQGTQKFTLDMPDNMATGSDDGI

SEQ ID NO: 6543 - protein, 159 aa, Lactobacillus casei
MATNISILVLAMIVAGMGIMLYQRRKYFYLGTFFIGHGMTSTVINLKNSGHYVINITNVSENPQAPASFKIEEGSFRKDGTVIDLKPEKLSTFTYPNSQALMTNDWGGHEESESESHQISLQNHALMLSGEELQPLNQGKVVTVKQFMQNKKKPKSAKV

SEQ ID NO: 6544 - protein, 255 aa, Lactobacillus casei
MTFWLFIYFIGAGILGGLLASIAGLASLVSYPALLIAGIPPVIANVTNTAGLVLSGIGATASSSRELRGEGKLVTGLTALTLAGGILGSALLLIEPASTFEHVVPFFILSAGVLLLVSGHQADRKNVPALRDQNKFGLVLKAIGLFLIGAYTGYFGAAGGVIILAILTLSLPQRFAVLNAFKNVMAFMANAVATVIYAWTGKIDWVVVLPLGIGFLIGGYCGPIVVRHVPVRLLRILIAFAAFGLAADLFVQAYF

SEQ ID NO: 6545 - protein, 346 aa, Lactobacillus casei
LEAFIHGRTRSVKDESPLSRSLQTEHYNGAVAVVTADKELAADSQGFAHIDMKVPFASHTLSGAGTVTQQFFGVLLMQFVEKGALKLTDKLSQYVPEYKQADKITIGQLATMQSGIPDYLTLMAEPFKANAPATLPDERLALQINQHNAADMDLAKVLDVVDDQPLAFKPGSQTAYSATNAILLGEVLDRLTEERPLEAILKENIYDPLALTHTKIGTSHAFAESYHWIAGNPNLAGKGDENQADRGLVTTIDDLEKFAQAVLKGKLLKAGSWETIFKAAEGGYGFGWHKLADGWLGNSGSVLGYTGLLSINRKQKKAAVALTNVLKPQTDMTEFVDKIQQAAQEL

SEQ ID NO: 6546 - protein, 226 aa, Lactobacillus casei
MSTFEKIQQLNPDKQIHQLTDPAFADYGVTYPQYDVSELKTFMDQNVKIPAPTAANLYVPSNPDMEKIPVVQQIGRDVFAGLPIEAGECAGHAEALTAVEFHQGSEVNVFFTDVVMVIGKRGQMHAGKFNAEKNAKLFFVPAGTVVEFFSDTLHYSPCEAHASGFKFIVMLIRGSNQPLPADYHTDNKLIVKQNKFQVVHATRTDKIKQGIQVGVTGELVKVAHLD

SEQ ID NO: 6547 - protein, 312 aa, Lactobacillus casei
MILTVTLNPSIDVSYPLEHLKIDTVNRVKNVRKTAGGKGLNVSRVIHMLDHDLTATGFIGGYFGKWLENQLDRDGIAHDFLPIDAETRSSIAMLHDGGKQTEILESGPTITPEDAQKFLDHFDKLLDQADLLTISGSMPQGLPEDYYTQMIAHAGAKNVKVLLDTSGATLKSALEAPVKPLLIKPNDEELAGLLNREVDKTDYAALKQDLQDPIFDGVDWIVVSLGSAGAFVKHQDKFYHAAIPKIQVVNPVGSGDSTLAGLAMGIHDGKSDEDIMKTAMTTGMLNTMEAETGFVNPAKFDTYFAKVTIENY

SEQ ID NO: 6548 - protein, 333 aa, Lactobacillus casei
MTVNLTAGQFKHLQQLSDDNNVISALAIDQRGSLKKMLAAAANKPADETTIVDFKKAVSEELTKYASSILLDPEYGLPAAKVRAPQAGLLLSYEKTGYDATEPGRFPDLIDNQSALRIKNEGGDAVKFLLYIDPDEPDSINDRKYAFVERVGAEAKANDLPLFLELVSYDGKTNETGTAAWAKAKPEKVIKITKEFSKPQYNVSVLKVEVPVDQKFVEGFTDEGVTPVYTKEEAAKYYKAQSDATDLPFIFLSAGVSNELFLEELKFAKEAGSTFNGVLCGRATWKPGVKPFAAEGEAAGKKWLETEGKANIDRLNKVLAETATPWTDKVTHD

SEQ ID NO: 6549 - protein, 172 aa, Lactobacillus casei
MIIAIGNDHIVTNEKIQVSNMLKDMGYKVIDEGTYDTHRTHYPIYGKRVAEDVADGRADLGIVMCGTGIGISTAADKNEGVRAAMANDATSAVYAREQLNANVLGIGGAVTGIHLIEDTVKAFLDATYKETPENKKIIDKIDKIAKPNPEQKDNPHFFDAELEKWDEGVYHD

SEQ ID NO: 6550 - protein, 142 aa, Lactobacillus casei
MDVIIGADKDGFAMKEQVKKYLEDHQYQVADVTPEPAEDFVESALAVTKKLLNGDAHKAIMFDRYGVGSAMASNKVKGMVTAVVQEENTAHMTAEHNGAKAIAIGTGITGPDRAIAIVQRYLDTEYAGGRHQIRLDMLEKMI

SEQ ID NO: 6551 - protein, 254 aa, Lactobacillus casei
MLKDERLLTIRNLVDRKGIVTVNEIGDSLGVSTMTVRRDLEELADRNELIRIHGGAQSTHFKPLTELSRNEKRSIHVNEKRKIAATIADIITSGDTVYIGPGTTMELISQYLKKPEVRIITNSLPVFQSFQDRADYFSLKLIGGQLRERSGAFIGSLANEMLAHLTTTKAFISVNGIADNHISNASPEEGQTQRIALNNAGMKFVAADHFKLNRQDFYSFYDLDQTDGLITDDGISADDKQHFSEYTSVIVGKS

SEQ ID NO: 6552 - protein, 208 aa, Lactobacillus casei
MNTFIFDIDGTLLDNVEGYLYGLQKTLRRHGRKVPIQDLTWTNGRAGVDSLKELGFSDEEVPVVHEEWREDSKAFLTDVSWFPNMQAVLKQLGRQYKLGLVTSKDKPQFLEEDKKYHFSPYFQTVVVAGEAKRNKPFGDPITLARERLGGNPETTVYIGDTSTDAQAAANANVAFALAGWTTPPSPAVAPRIAVLQRADDLLKLPDLG

SEQ ID NO: 6553 - protein, 374 aa, Lactobacillus casei
MRFLHTADWHIGKKLNDFDLLADQQAVFDRLVAVAQAQQVDGIVIAGDLYDRALPSEAAVAVLDQMLVKLNRDLHYPLLVISGNHDSAVRLRTGRSWFSATQMYVNTQLAEAFTPIELDGVQFFLLPYFEPFAVRDYFQDQTITNVAQAIRPIVTKMKTLFKPGMRHILVSHFFAAGSDHSASETKVNVGGLDAVPIDDLTAFDYVALGHLHNHNALHGEPKIQYSGALLKYAVGEAKQEKGVYIVDTKTMQREFVPLKPQHDLLELKASYADLTDPAYYQKQDRDAYIGIDLTDTQVIPNVMAQLRQIYPRIISLRRENGVQAVKPLQQRQRDLDPVSLLKAFYEELMQTDLTADQLKWAKSGLAAAESEQKR

SEQ ID NO: 6554 - protein, 1041 aa, Lactobacillus casei
MKLKQLHMQFFGPYADETVDFDDFQTSPLFLISGPTGSGKTTIFDALVYALYGETSGERDGVQMRSNFASHHDLTKVTLTFEHDGKHYSVTRQPQQLQQKKRGDGLTEVKAKVVLAIADGDKQVAEYTKKNQVQAQLDAVLHLDAKQFRQIVLLPQGDFRHFLDADSNAKEDLLRDLFGTQLIQRWQTAMLAKTKEQGAEIQDQERMLNLLTSQFDFEVEPDENATPADKLDLMRETVEKQAVTVAARQKAADSNHHAYQVAQAALQAGRQLAQAFKDREQTTTALAELAEQEPVQQDRLKRMAQLTWVQQHEAAAQRVETTTQDLATARKQATQIKATLVATQQSMDQAKTSLVELQQQEPAVDAKKKQLDQLQSVREQLVAMSAQKQQATMKAHAVTKASAALKKAQQKLADDQQSLTQQQTELSDLLVTDLANRAAEHKQLLATLTPIAANYQEAQTDAFTFGEKLAKVKTSLEKATETSKTAAQQLNDLQQTQIKQQIARLAAKLEPGTPCPVCGSLEHPHRAVATTEPLVTEAAIKQAEQTRQQAAAKETTLQTQLKNLEDQQATVTRKASVAQRDFVEKLAQQPSLLSSDADNADILVQLSAFEAETTKIVKKLAAAEAKQTALETALKSLQTAVTKDTDKVQAAQDAVNTAKLEAATATSALATMQAALPEGTSDLATVTAQSAELTQAVDTYQKNRQAAQDKVSDLDRQLAGLHADERHATEQIAKLEKDHQEATAAFLQAVTEYFGADGSKQFTALKEQLDQLPILQQQTQDYNNAVLKQKTLLESSNKTIGDQHEPALDQLEEQATLTEAAATKAQTALIEVQQAHDTAKKLLKQAADILAKNKAALAAYADLQTLTTVMNGNGPKKLSLERYVLQAYLQQILDVANTRLQVLSNQRYQFVLHTDLGTQKIHSGLEIDVYDDQVGEQRAVQTLSGGESFIAALSLALALGEVIQQESGGINIDALFVDEGFGSLDTNSLDVAMNALESLEGESRLIGIISHVTELRDNIPDQLQVQPAGTGRSRLKVLHMA

SEQ ID NO: 6555 - protein, 132 aa, Lactobacillus casei
MVMFNETIGIFASTEHGHCQDGFMFEVDFNDSAPMNIVPTTSAADALKELMAYHNITQSEFAEHIDVSQKQLSFILNRHAYMSINVARKIEQATGLSARWLLQLDFNYRLSQAETDDLAQVKRFEWAKPQKN

SEQ ID NO: 6556 - protein, 47 aa, Lactobacillus casei
MASLSKEQKKALIAKVEKERQEHPEKKPKKSGFETIDEEAERLENEN

SEQ ID NO: 6557 - protein, 158 aa, Lactobacillus casei
MANEVMNRRNNELMNDVNDPFFDNLARRFFGPVSDWMDWATPSIASTAVNGLLTDVKETKDAYEVHVDVPGIDKNNIKLNYHDGILSINVHKDDITDHADKNGNVMMSERSYGTMSRSYQLPNVDDSNIKANYKDGVLNITCPKLTESKESGHNIEIQ

SEQ ID NO: 6558 - protein, 365 aa, Lactobacillus casei
MDWPPEKVAAFQQALLDWYDGHARTLPWRQDHDPYHVMVSELMLQQTQVQTVIPYYKRFMTQFPTVEALAAAPEAAVLKAWEGLGYYSRARRLQQAAKQIVNDYGGKWPQTSAELQTLAGIGPYTAGAIASISFGEVVPAIDGNAFRVFARLFKVDADIARPQTRQVFYDLIRPLIPKDRPGDFNQAVMDLGSSYMSASHPDPEHSPVRDFDASYRDGVVADYPVKTKKPRPVVHRYFALVVRSDAGYLFEQRPSTGMLADLWMFPLIDMADLEATMMSDQLDEVSQTFAASSGLALTFADLGVKQVQHTFTHQRWQMTLIGADAKAEELKFIPARWVAPKDFGKIALPTVQKKLNQALGLDDSD

SEQ ID NO: 6559 - protein, 263 aa, Lactobacillus casei
LTVKVTKDIAYGDAPLQKLDFYEPDKPNGAAILDIHGGGWFRGEKNKEGSMAERFAALGYAVAVPNYRLAPEAFFPAARDDVLAAFSWLRDHVETKKLGVFGSSAGGSLSVDVGLAEGVPMVSWSGIFDIQKWFAAHPNVVAQPDTKTDFVNTASAKIDQGGRNDPFYKWFILNYVDADETKFPQVEPFERLTAQAGPMYLANSQEEIIPVSGIYQLGQAAATLGVPVTLQVIPGGQHAEGYLAEAWPETVAFLAQHLLKGSN

SEQ ID NO: 6560 - protein, 222 aa, Lactobacillus casei
LKTLVVISHPNIEKSDTQQFLKASAASLSQVVWHHLDANLPFDVAAEQQMIQETDRIVLQFPLYWYMAPASLHQWLTEVWVKQFVYDTHGGLLKGKSLGLVVSFSQPESAYQLGGQVGFSLSQFLAPYAALAEKTGLRLLAPLAIARFANQNDSEHQQLLIRYQQYLTLQHPDNFEAQAQWFIDRLQEDPKTTMLADQLATQTDEIDRLRLTLHELKAGESE

SEQ ID NO: 6561 - protein, 59 aa, Lactobacillus casei
MTTDEQWLINAAAQHEKDAVSYEKAAFFAALQTFVAQQAERREQLEAEIDGRSWNHEQW

SEQ ID NO: 6562 - protein, 174 aa, Lactobacillus casei
MQAMFDRLQRWSWLRGLLMILIGAWILIEPHQVYRSFLWIVAAVLIVAAIPKLVDGFSAKKRSGTYSTSLFTGIVYLLVALLLPAIVMPLMSMGPFIIGIVLIVYGINKIMSARHQQQYVNVAPWPTIVYGIALIIIGAIMVINPFRTVMMVFSLFGGLLVVMGILQLFGSKQK

SEQ ID NO: 6563 - protein, 210 aa, Lactobacillus casei
MSEFNWEEVEQDEYSRSATPSFVKLTTRSYITAMGVAPNRLADETFTDLAAAVTAVAKQISEGPNVGIKIPNFKAYRPYPLQAVWSGGDKISSRHVFRIWLKQPLFIEKAQFTAALAQLDFDPAIAKQLHFEQLAEGFEIQSFSDTPLDDSAVALTRIQTMIADNQLVPKYNDRHREVYVAGYSKTAPVLLRMALDENFGQIDEEHVVYN

SEQ ID NO: 6564 - protein, 273 aa, Lactobacillus casei
MANEFPQVMTIGGTDSDGSAGVQADLHSFFMRGVYGATVLTAAVAGNSYGIQDSMVMPLPFIDAQFKSLAADLKIRAAKTGMLADRALVQDIIKNWQQYDFGALVVDPVIITKHGAMLLEQDAYDAVKNDLIPLATVVTPNHYEAEHLTGMKLDTDANIEAAAHQLQDSGAKNVVLKGAHDNPEQKEVRDFVLLESGKTFWLSEPYHNTDRVNGTGDTLSAVITAEIGKGNTIEDAIRIAKRFTNQAIGHPIAVGHQYGPINHWANQIVYPQN

SEQ ID NO: 6565 - protein, 353 aa, Lactobacillus casei
MLNLNDTHLAALIAKPLSVSQLRQQISTAYQTETDRLADSPLWGANDDALTALLASYTGLMRDKLYQTLQNMASIPANFLQTLWFKDTTTDSQHSEITLIQATENDNNTLLTIVNPLSADATLKAVNLPTLLQITASDSHALPYDDDEVKALSALTKALNQGGYQFSSIDETVLQPVNGLHFKTRFDNLKPLVAKKTVVKAGAFSINVTLDLESKVLDYQILDEDGHDWKDLGSEDVKSDRFEWASTTIPEELVNHHLKLVVRVAAGNNSPALDELFVIASNNAILMRQGKQKGVYELPLPNQKLFTVLIDPDNNMVYLKYPDPETQVIELNRQYPFIGEWLKAVLPQKRAFN

SEQ ID NO: 6566 - protein, 278 aa, Lactobacillus casei
MSIETSLTYQKKFFSDFTDAWHKKSRYRLYQGIDATAENLRLDIEEAPGYILAYDKSAQAELHDFLQIGFIDFLRQHIPFFEVNDQGTVYFGNWYHRRDFGHINVILRAITQSTDEQRKILPQLEAFSADPDHYLDRQLDAMRKEVYRDVDSLHTQIDNLEAEAAPERDQPAQGGSGFRGLLKNFIDPNDDDDPAPTSRTSAADASQLKARFDKEKLAADDTFDKRKRELEVSAAITRYEYQAVMNTYSSVAEFENVLANLKDDFMQSLKLEGGRTNA

SEQ ID NO: 6567 - protein, 217 aa, Lactobacillus casei
MKIAVLGATGRAGSAIVAEAQRRGHEVLAVVRDTQKAASRLGQNVPTLVKAPLELTEADLDNVDAVVDALSVPWGSGRGYLHLDFATHLISLLRNTDTLAVFILGSASLSMPGADHPMILDFPESAASQPWYDGAKYQYYEYRFLQMTDNVNWIGISASEAFPTGPATSYVAGKDTLLVGEDGQSHITTGNMALAILDQLERPTALQDRITVRDADA

SEQ ID NO: 6568 - protein, 56 aa, Lactobacillus casei
MLRFLTGLVRAQQKKTPRIGGARGSRVSAIGGGTDLFLLWRSKNEKSWVGVVVRRG

SEQ ID NO: 6569 - protein, 791 aa, Lactobacillus casei
VSPVNLNSLTTEEKVKLTSGKDFWSSEAFPEHGIPSIRMSDGPHGLRYQAAEADHLGINDSVPSTSFPTASASASSWDPELIAAMGEAIGLEARSLGVDVVLGPGVNMKRNPLCGRNFEYFSEDPFLAGKLGSAWIQGIQKQGVAACLKHFAANNQENGRLSSNSIIDPVALHEIYLEAFRIAVTEGHPESVMCSYNKVNGRYASDNHYLMTQVLRNQFGFDGAVITDWGALNDKVASLNAGTDLEMPGDQHLFDKEALKAFQTGELRPASLDRAAANIAKMARKQRPKFTGSREDLLHQHAQLAQKIAESAIVLLKNDDGILPLAANEQVAVVGELAKETRFQGAGSSHIKAAEQVPILTGLKQAGIAYDYAAGYRLDDQVDEEAIAQALELARTHDKVIFVAGLPDNYESEGFDRQNMALPKVQNDLLQAIAAINPHVVVLLVAGAPVELPWLDQVQAVLDLYLGGEQIGAAAGRVLTGQVNPSGKLAETYPVRYADIPSAELYDHRTRSVPYVESTYIGYRYFDKAQVPVAFPFGFGLSYTSFVIKNARLTDDHVTDDQPVTVQVELTNTGSRDGAEVVQAYVQEQAARPLRPIRELKAFKKVLVKAGETMTVTLAIPAQAFKEWHEQTQTWELPDAAKAVAIGTSSADIVSVLPVQVHGQAFTNFENVPDWYTTPSGKPTVHDFEQLTGQKVPPHHEFVPGEFTRLNTPREMQKYSWLLRLVARTVIKMRTKDYIDKDGPEAKFQQAIVLDTPLIRLAQQASGALRLSMVDRLVAAANHQYLKMIFR

SEQ ID NO: 6570 - protein, 318 aa, Lactobacillus casei
MKKHLLLALAGMALIGLTLTGCGKQSKAASKETVKVGILQLMDQTALTEARKGFEAELAKAGYKGKRIKIDYVNAQGDQANLKTMSDRLARGKNDVNLAIATPAAQALQKADKKTPLLFTAITDPKSAGLVTNLTKPDKNATGVTDLVAISDQIDLLHKTFPQAKTIGLMYNAGEPNSVYQIKQAKVHLKKLGLRYQIKTAATTNDVQQAAESLAKDVDALYLPADNVMAAAMPTIGKVAKEKQIPVVPAASTMVKDGGTITKGIDYRDLGKQTAKMAIKLLKGTPVKKLAVEKPANVKTVKNDAMLKAVKQKVNLPK

SEQ ID NO: 6571 - protein, 322 aa, Lactobacillus casei
MKLKRIAAVAATALAIMTLVGCGKSTKAAADKSQVKVGILQLIDQQALTAARKGFTDELAKAGYKGNKIKLDYVNAQGDQSNLQTMSQRLARDKNDLNLAIATPAAQALQKADTKTPMLFTAITDPKSAGLVANPEKPNKNATGVTDKVDVAGQIKFIHKVFPKAKKIGLLFNAAEQNSQVQVKLAKAAIKKLGLTAVEKTAATTNDVEQSASALMKQSDVIYIPTDNTMAASMATIGKVSTKEKVPVVPADATMVKLAGVATVGINYEDLGKQTGKLAVQLLKGKKVKDLPVEEPSKTRLVINPERMRQFGLTKAMLEEAE

SEQ ID NO: 6572 - protein, 323 aa, Lactobacillus casei
MDIVTSSIAQGLLWSVMAIGVYLTFRILDIADMTAEGSFPLGAAITAHAIVSGTGPIVATLMGFVGGAAAGAVSGFLTTKLHIPDLLTGILTMTGLYSVNLFIMGKANISLIGTVKTVFNLTDSGDATTIGIMVGAIVVAMVIGILVFFFHTEMGLAAAAVGNNQDMAAANGINNDAMKIIIYMLSNGLIALSGSLMAQTNGYADLSMGIGTIVIALAAIIISEILVRGVPLWARLLMIIVGAVIYRLIIAVVLDMGVDPNYLRFFYALMLTVFLSLPLLKKKLFQLKVRHGNRHPVKQRQAVTTKTADTMAVSPMEQQKEAR

SEQ ID NO: 6573 - protein, 267 aa, Lactobacillus casei
MAVLEVHGLHQYFEQGTVNENHALKGIDLSLERGEFVAIIGGNGAGKSTLLNSIAGTLPVNQGQILIDGKDVTYQNVAKRAKLIARVFQDPRSGTASLLTIEQNLALAEKRGDWRNFWASGVKRRDRQHFQEKLATLGLGLEKRLGAEMGLLSGGQRQAVTLLMATLKKPALLLLDEHTAALDPQTSATVMALTDQMVRAQKITTLMITHNMASALKYGDRLIMLDHGEIAVDVRGEEKQNLTVEDLLTLFKERSGQEFADDAVLLS

SEQ ID NO: 6574 - protein, 319 aa, Lactobacillus casei
MQFFQAFIHDGQKATLQTITTDDLSAGELLIRVAYSDINYKDALAYQPHNQIIRQYPQVLGIDLSGTVVASQDPQFKKGDQILATGHGLGVSQGGGYAQYARIPATWAMPLPPNMTLETAMAFGTAGLTAALCVNALMQAGMTPEQNPKILVGGVTGGVGSIALQLLENAGFSNRIAVVRTPDQQSQVRDLGATGTLALDELPKGKALSRQQFDYAIDPLGGSFTSSLLPSMRYNGAVALCGNAAGTSLPLTVFPFILRNISLLGVDSVSAPTAQRQKAWTALAKLKPVPFQKISLADLPQALNNHFTHHPVRTVVSMA

SEQ ID NO: 6575 - protein, 393 aa, Lactobacillus casei
LIKTHKIKLYPNATMRRELERLFNYRRFCWNQALETWNSMYDASLVMVDKALRPNERKVRDELVWNKADWQYERSAQVLKFAVNDLGKAWKNYFNPKMPDHDKPNWKSKKRSRKTFKTDRAQLVNGKLRLDKPHSAGTWYDIKLAEQPRWQGELKQVCIVQDADGYYASFSIEVQTFVEKRPVLTATGVDANIGKFDYQTATGYATQPTLPERLPLLYARIAHYQRQLARKRKVSPKHFNSKAYRTTRTKLKRQYQRVERIQTDLLQKFTTKLITDYDLIGIEDLDNRHMRMNKHLAKNLHRSLFGKFKVIMQYKADWYGNTLVLADQYYPSTQRCSRCGYVKTADERVTLSGNLKHRTGHDDYHCYQCGVKLRRDENAVENLIAYAKSKVTG

SEQ ID NO: 6576 - protein, 888 aa, Lactobacillus casei
MPTTTKALTLLTPSDLAAEFDTNLTTGLTTDAVAKHRQQNGSNQLTAAKKPSLFRQIAHHLSDITSLILLFAVGLSAYLALTTDSNWTKTIVIGSIVILNVVIALYQEHSAEKALAALKAMTVHTVTVIRDDKTQTIQAADLVPGDLMLLKAGDAVAADARLIESQELEADEAVLTGESESVDKSAAPLAEVPENLGDAANCIFSGTAITSGKATAIVTATGMNTELGKIASLLNQTKKQVTPLAKRLDALGKRLSLVAVLGGALTMLLAMLYHQETLADSLMLGVSLAIAAVPETLPVIVTLSLAHGVQKMAKRRAIIRQVTAVETIGNVNVIASDKTGTLTQNKMTVTHFWSFGQFNIQKATAEPLTTDTRRFLSYLGLATNAKLTDQDEPDIGDATELAIMRLLAHYGLSRDDLETRYPRIAEAPFSSAKKTMATLHRTPDGHYLAIIKGAVDRIAFSAPNWQTEAASVHDQMTGQALRVLAAGHQEFTADPGADWENQLTEVQPLGLIGLIDPPRPEVPAAIQAAKDAGIVTVMITGDHLGTATAIARDIGILDGSHRAITGHELNQMSDETLAATIQQIRVFARTTPSDKIRIVKAWQQQQAVVAMTGDGVNDAPALKAADVGIAMGITGTDVAKNSADMILTDDNFATIIDAVAQGRTVYQNILKAVEFLISVNFAQIFTMLIAVLIGWGAVMTPEQLLIVNVLADGIPGFFLSRELAEPGIMHLKPIPKKASIFANGLSKRVAVRTATYVGLILGIYAIGRFVVSPDQPVVGMTMLFLTLAIGSILDVFPIKTRARLNRTALTSNPILTVSLLGTMAIILLLAILQPFQQIFQLAPLTLGQWLIVFVAVWLPMVIVESYKRWQHRHELAAWHQPNLVSDNE

SEQ ID NO: 6577 - protein, 325 aa, Lactobacillus casei
MRQEKDPFISIVLPVYNESAGIGETIKELANYVRARTERYELIFVNDGSTDDSADQIRAAVAKNPTIRLVDFSRNFGHQLAITAGIRYASGDAVVVMDADLQDPPRVIPEMLARWREGFDVVYGKRRKRSGETWFKKLTAETFYRVLKAVTSIDIPVDTGDFRLMDRRVVNVLKQMNEQDPYVRGMVSWVGYKQVAVEYDRQERTAGKTHYPLRKMLHLAMNGITSFSTVPLTIANWLSGFFLLIAVATTFVNLLLGRLSLLTWVISATFFVGAGVTFTIGLLGNYIGRMFAESRHRPLYIVADTYGFKTQAAQQPHYRYHALQN

SEQ ID NO: 6578 - protein, 737 aa, Lactobacillus casei
MKKIRQWTVDWWLIGILILAAFLYAWNIWEAGNANDYYTAAITSMVQSWHNFWYGAFDPAGFITVDKPPVALWFMAISAKIFGVHGWSVVLPSILFGIGSVALIYNMIKPRFNAWAARLAALALTLTPIVVADSRTNNMDATLQFFLLLASWCLMKAISTRKPWLVVVSFALIGVSFNIKMLQAFMILPALLLFYWLASNQKLWRRLTTLGIAAVAMAVTTLAWPMQVDSTAATQRPYVGSSETNSEMELAFGYNGTERLLGQTTGTGAAFPGMGNNSKSKTGGTPPTGTKGKTGTAPTGTKGKSGTPPTGATGKTGNPPGGKSTKGTSGQPGTGNTQGGTPPTGTKKQQATVKTKKATGGKMPANFKKGNFKGGPGTGGGAPGGRKGGGGGGGAFAIGTAGPLRLLQSDLGPQISWLVPAALIGFISAFAYYLDRKRKWYQTTSQQNHLLFWMGWLVPVAGFFSIASFFHPYYMIMLAPPIAALFGIGIVTMFKQFKLGFKHWQSWLLPLAIVTTTALQAWYVSLYYQWQTWLVVGAGLIGLALLFIGRTRSWRKSALGVAIAAILVAPGFWSLTPTLAGSSAAIPSAGPSLLTSGGNSGGIGSGSVDSGLLKYVEKHQGSAKYLFATSNASTAAPYIIKSGKAVMAIGGFNGTDPAITLKQFKALVKKGDMKYYLSSGRSGNSKIESWVTKVGKKVSSNKYSSQSSSSTKSPGGMGMGGGMGGGTLYELDASMVK

SEQ ID NO: 6579 - protein, 135 aa, Lactobacillus casei
MRLKLKQFISFGLVGGINTILTYLIYLTLYQLINPTAAMGVGYGLTSILGLFLNDTWVFKVKDHRQLKSVAPRYYFSYGLTFILSLVLTSFWNDALGLPKPLAPMFSLMVTVPTNFLLSKFWVFREKGVTAHEKN

SEQ ID NO: 6580 - protein, 231 aa, Lactobacillus casei
MTVKPKILVIEDDPDLNESIVDFIQDFAEPEAALTGADGLYQAEEGVFDAIILDIMLPELNGFDLLKQLRAKQVKTPVLILTAKDALADKLRGFELGGDDYLTKPFHREELIMRLKALLKRTGHFFDDDGLTAGPYEVYLNRHEVLINGQPVSLNGKEFDLLVYLLQNQKTIITKDQIFDRLWGFDSETAVSVVEVYMSNLRKKLKPLKVDGWIKTIRNVGYIFQEPEGRE

SEQ ID NO: 6581 - protein, 430 aa, Lactobacillus casei
MNADKGIKRQQRRLFVGQLLSFAGLFLVLGFIVFFLYERSVYQDIDHTLEQQKTMIIKPATGMTTPNAPRQPGGSRPILFRMNMVVFNKKGKIINQAMLGERFYAYFKKLKLDRQALNKLQTLATSTGTFRTLLVKVPQTAADPQYAGHYVLILQNTDAQEAAIRSFRQVLIVTIILFWALALGLSYWLSTRAMRPIVRSWQRQQDFVADAAHELRAPLAVIQSKQESLLTKPQATIIDESEAIATSLGETKRLRQLTDDLLTIAKADSNTIEIELTDLRFDQALAPQLASYHDIAKSQDKSFTTKLSADGHAWFDAARIKQLLVILLDNAFKYTQAGDSIWVEVTQTPRDWQLIVGNSGPNIADADKSRIFERFYREDASRSRQTGGSGLGLAIARWIVTIHHGHIEVKDVHPHGVLFVVTLPNKPRGA

SEQ ID NO: 6582 - protein, 126 aa, Lactobacillus casei
MQIHFDEGAIDKIKPHLDPDKKLLLTFEDGVGPYSQHAMIHMQVQFSLNVVKASDPATDYDTKIDSNLGPILIKGYSQEDLNANMNVHFNKTLNTLILSGDGGDIDTNMGFIDFTEANGVRNNPAR

SEQ ID NO: 6583 - protein, 219 aa, Lactobacillus casei
MTDTVAAPKLTNNDLGNVMFDRHSARKFDPNVKISRDELQEMIKEATTAPSACNLQSWHFVIIDTPEAKEKLKKAAMKFNYPQIDTSSAIIFIAGDTQSHEVYRDVWTKVYKAGKISKEKLDQIFNTFLPLYEHASPEFLTLDATIDGAMVGMQLLLLARAHGYDANPWSGYDFKTIIPTLGLDPKRFVPVMAIAIGKAAEKPLKTDRYDVNQLIDYLA

SEQ ID NO: 6584 - protein, 368 aa, Lactobacillus casei
MIDAVKTDPFGEVNAIDVLDLASLEGRAEKVLGRGEFGYISEGSDDGYTMRRNTTAFQDVEMLPRVLQGVEKPDQSTTFLGAKLASPLLTAPIAGNTLAHSSGELGLAKGAKEAGIMMSQSTFASKPIAETAAVSDGAPYMFQLYMPKDWSYCEYLLDEAKNAGALAIILTADSTLGGYREKDVMNHYHLKGRLANLEGYNSGQTGVGAGGLFKESMQKLDLALIDKLASYSGLPIIIKGIQHPDDAVAAINAGAAGIYVSNHGGRQLDGAPGAIEQLPAIAAAVDHRVPIIFDGGVQRGTHVLKALALGADLVGVGRPFSYGLALGGWQGVKAVADHLKMEINIAMQLTGCQTIEDVKRMKLKTRFA

SEQ ID NO: 6585 - protein, 336 aa, Lactobacillus casei
MDTITAYLDSLFASFPDNPKTRQAKADMLANMRDYYRDLLREGKSEETAIGAVIRAFGSVDELREDLGLAPQADQANTDATAEPDNAVSETELSHFWHIADRFATQIAFGVLLCCISVALPAYTTDSSLEVFGIIGMFLLDAIAVGLFIWAGTMFSLQKKRLNGRPLSESAKRFAQETTDTYQRQFSAGLIVGIMICIVALIPPILSTYLSHFISDDAGGALFLIIAGLGTYLIVYVAINYSQIKRYTDATAVPDPEPRLHHSHRDNFHTSQHHHNQRTSQDIALFRQIYWPLILVTYFLVSFLFHTWTYSWVIFIIGGACQNIIISLIARRDESL

SEQ ID NO: 6586 - protein, 106 aa, Lactobacillus casei
VISSDAMRGYNDALVLAILQQGDSYGYKIGKEIRERTHDQYMIRETTLYAAFTRLSKNGYIEAYPGDVTNGKPRTYYRITPSGRAFLAMKAEEWHQVKHVVDLFLN

SEQ ID NO: 6587 - protein, 101 aa, Lactobacillus casei
MQADNGKYHSGIDPVKAKRLNLLSRLATFTCILMYVSYIPEIMANFSGTPVNPIQPLVAMINATLWTGYGWMKPAKDWPIIIANVPGILFGLITFVTVFVH

SEQ ID NO: 6588 - protein, 99 aa, Lactobacillus casei
MAEQEADTVTRVQKQEGADAIMDKGFVTERDIPEMMAASWSEKLLAAINDELRLRTVSNRAVLQRFHYYMGDGSIIYDPGQLNSEGAKIALQHALGFRK

SEQ ID NO: 6589 - protein, 341 aa, Lactobacillus casei
MPKNIAIGFTEGLPITEPNSFQSFTLPVPTPEPNEVIVQVAGVSVNPVDTKRRQTAPRQETPQILGYDAVGTITQIGSAVTAFHVGDRVIYAGTTRKPGSDQQFQAVDADLIALAPKQAPTADLAALPLVGLTAWELLFEKMGFIPEYNANKGQHLLTINGAGGVGSMLSQLAQWSGLNVLATSSPKNHDWLRAHGVATPLDYHKDLVSQVHQAGVQTVDGVALLYHPEPYLATASQLIRAFGHIGCIVGPQSGLDLAVVKDKAASFDYEYMFAKTDFDYRVATQGAILSKLLTLYQDGQIKASVTKEFTGINVANLKAATKLVEEGHMVGKVVLTGTFSD

SEQ ID NO: 6590 - protein, 44 aa, Lactobacillus casei
MATAQPFRLEATYTPISKRSCSRSYEKARSMTKEAAREKIEYKA

SEQ ID NO: 6591 - protein, 120 aa, Lactobacillus casei
VKKLSTKRELIGLIVVLVLAAAGFAFFAWYTMRPDDVIGTIATISFGIVLAALIGIALFLDAAATTRWRRFWVDLLFAALMLALIDYFFLDTTTPWQMLIAGAGLALALVALLAIRKLDE

SEQ ID NO: 6592 - protein, 159 aa, Lactobacillus casei
MNSFDVLLIGLDVVLIALAGYYLYWQHKINFASRYAVSQLVWAVLLGFWFMTTRVNNMPYIVFISIFLVLSIMAGTGGLAPTRLIANGLLARVIPYTNMSSITLTPVSLPNGQEWVVAVFALSKRRMVRLTFQASLQNLMTELTKVLPKTVPVTVQRMN

SEQ ID NO: 6593 - protein, 388 aa, Lactobacillus casei
VKRTDSWFYRRFINNKFMVFLIDLLLALLVIFVFTKIAWVFQPVVDFLGIIAPPFIFAGILFYLTVPIINRLEKAGLHRGWAIALLFVVLIGLLVWGLLRFIPAVSNQITSIVDSAPQIFTEIGKWLDDLNDKQNVLSQHDLNNIASEVQTFFTGKQGAFVTGTISQLQNLIGIVGNVVITISTAPIILFFMLKDGDKFTPMVLHIIPTKLRGSVKQMLHEMNEKVGSYVQGQITVALCVAIMFMIGYSVIGLRYGLIFGLLACPLNLIPYFGSALAMIPPLIMGALTSPKMILAVIVVFFIEWLIETQLISPLVMGSKLELHPITIVVVLLTAGNLFGLVGVILGIPGFAVLKIVVTRFFSWYQQVSGLYETDSPTDDVDQKGVPHE

SEQ ID NO: 6594 - protein, 64 aa, Lactobacillus casei
MNLLRGAKWTLITLTLVATLLLFSNYATAGILLMALDIFLSFFYAVIKSRCDRRQMHKMPLLHN

SEQ ID NO: 6595 - protein, 208 aa, Lactobacillus casei
MPTQASQKRWKQILQTIYDAIEDHGYPPTVREIGKSVGLSSSSTVAAYLEKLLAAGLIAKDPSKPRTIEVTAAGRDYIGVQAEGIPIVGTVAAGVPITAIENIDDYFPVPDDLPYSADELFMLRVQGSSMIKIGILDGDQIIVKKQNDAENGQIVVAMTEEDEATVKRFYKEKNGIRLHPENDDMEDMFFPDVTILGIVVSLYRPALV

SEQ ID NO: 6596 - protein, 161 aa, Lactobacillus casei
LKKLVWLMLLLILSGCSQGTPTAKSSSTRSATSEQASKPVKSRKKAKKAVPKATLSTLVGHAFVQQDDQKKAIRVLSSTSGYYLETLSNQDGDFESTDQGIFAAQLTLKGRIFTFTGKAQPQAASNTVQFQLTKKGLLKQLPDGPFYKKVPKDDLDQLNRP

SEQ ID NO: 6597 - protein, 315 aa, Lactobacillus casei
LTAFISSVFGVLEILILIILGYFLTARGWFNNHSSKVIAKVVTQVALPAYMIVTIASKFTAGMLLRLLPNLLFPVLSMMMLFALSFLVCYLLKVPKSRKGTFKSMFFNSNTVFIGLPVNLALFGPRSLPYVLVYYMANTTIFWTIGVYLIQGDGPKPARFNLKKALGKVFSPPLLGFMLGIVLVLLNIKLPTFLMSDLTYIGDLTVPGSMFFIGIALHEAGWSQLRLSKEALGIFSGRFLFAPLLMTALVAFAPVPTLMKQIFILQSCMPVMTNAPVVAKLYDADADYAAIMVTETTLLSMIVIPIVMTCIQFIH

SEQ ID NO: 6598 - protein, 205 aa, Lactobacillus casei
MINLSANKLSPREQYKLLSGSIIPRPIAWITTQSTAGIINLAPFSFTTGISNQLPLLSVSILRDGGQRKDTAVNLLARHEAVVHMVSVDLTKAMNQTAARLTPDQSELNLIDLPLVASTEIQVPGLQSARIRFETQLYQYVPIRDRAGVIITDLFILEVRQFHFADTVLDLPSLHINPAALAPVARLAGPTYAELGQTFTLRRPK

SEQ ID NO: 6599 - protein, 320 aa, Lactobacillus casei
MRRERIRKNRRRLYLTLTGIGAVVIFIGVFVWLVLRGAKVQGPTASSSATSISISSTVTSSFKSGTYTASGDVTDTNGDHHDLTVYVKLTSSKTYTRLIILDAGSQPQIINDTGDVKQKKGKLTLSSEHANVYTYASAKTYKHNQPTTTVEYASEGATGTVHDYTTALKKELNNTITLKGKTPHNYRYLTTSLPLQRSKKKLLSLDDFKTKQTASSSESSSATSNYSYSEESQYSSEPTSSQVSVAPTPSAAPSVESEHSQSNNTGQAGGTAGNHSNGSTGTSTNNGGGNGQSTQNNVPDNSQTPSSTPPSSTPSANSNH

SEQ ID NO: 6600 - protein, 186 aa, Lactobacillus casei
MATKAEFRTRQLKRLQEAADETQAASETLMATLIKTTVWQQAKSIGITVSGPFEVATAPIIAAAHAADKAVFLPRVMPKRQMVFLPDPGREQLVTSAFGIPEPAYQADLVEPAPDLLIVPGIGFSLADRYRIGFGGGYYDRFLAEYSGHTLTLVPPVMAFPQPDWPIEPFDVPIETLILANGDIVR

SEQ ID NO: 6601 - protein, 116 aa, Lactobacillus casei
LKVTLERIYQKPQASGFRVLVDRVWPRGISKVNAALDLWAKTIAPTAELRKWFGHDPEKYPEFKKRYLAELAANPDLPDFIKTLKAHEKDPIIMLYGAKDETHNQAVVLSEFLKDK

SEQ ID NO: 6602 - protein, 311 aa, Lactobacillus casei
MITCYQIQKQRNVQVATDDQANWIRVQSPLPQELQTLATKYGLPKTYVDAALDKHENARVEGLDPADDVPGLIVLRYPIEMTNEMGFRQFNTVPLTMILLADRVITVMDHPLQAFDDLAEQKLSPKPEEFALEVLWRVLHQFVLDMDKLNDETKQIEGSLGKAAKNTQLYQLMAMQKSLVFFDAALDHSGNLLKTLRAGERFFNTNGYLRRLHDVEVEVVEAQTMVRITNKLLDQYSTTVSAIVSNNLNLIMKVLTSLTIILTIPTIVGGIYGMNVRLPFANAYWAFWWLIGGTAVLCGIAAWWLWRKDYF

SEQ ID NO: 6603 - protein, 294 aa, Lactobacillus casei
VNTRDFEYFLELTDTRNFSQTAEKFAVSQPTITAAIKRLEDHFQAQLIIRDRRHHEISVTPAGEQLASHAAIILHQLDLAKQDIAWDQKSKIRFGLPPIIGSYLFPKIAVDLIAAGLMPQLETFEAGSAALLDQIKDGNLDFALLGASGPLVDPELRVIQIDTAPFVIITAENDPLAQQSHVSFATLADRQFITLSEGFVHTRAFSWFQQQQTFTPKVVYRTGDVLLLKRLVTQNVGIGFLTKVAIQADDHLASLKIDDPKQPAFTISFVYRQDRVLTPTMNRFAQILSAPKVV

SEQ ID NO: 6604 - protein, 555 aa, Lactobacillus casei
LKYTPEQILNNPFLNKGTAFTQEERDQYGLNGLLPPAVQTLDQQVKQAYAQLQTKPTDLAKRQFLMTLFNENHVLFYKLFSEHINEFMPIVYDPTIADTIENYSALFVNPQNATYLSIDDPDHIESALKHSADGRDIRLLVVSDAEGILGIGDWGTQGVDISVGKLMVYTAAAGIDPSQVLPVVLDVGTNNEALLNDELYLGNRHKRVYGQKYHQFVDKFVATAEKLFPNLYLHFEDFGRSNAADILNQYKDKITTFNDDIQGTGIIVLAGLLGAMNISKQKLTDQIYLSFGAGTAGAGITARVYEAFIEEGLSPEEAKKHFYLVDKQGLLFDDMTDLTPEQKPFARSRSEFANADELTTLEAVVKAVHPTVMVGTSTVPGTFTESIVKEMAAHTERPIIFPLSNPTKLAEAKAEDLIKWTDGRGLIATGVPAANVSYKGVSYAIGQANNALVYPGLGLGTIASTAKLLTDSMISAAAHSLGGIVDPDQPGAAVLPPVSKLDQFSQTVAIAVAEDAIKNGLNQEPISDAKQAVADMTWKPEYRPLPNSLELDLEE

SEQ ID NO: 6605 - protein, 328 aa, Lactobacillus casei
VTALSTSIQSVLTIVLLIAVGYVLRRQGRFDDQFGKTISDLLMKIALPASIFISVLQRLTLDKLVSLSSGLVYGFGAVILGYLIAFLLVWLLKVRPGRRGTFINMFVNANTIFIGLPLNLALFGDKAVPYFLMYYVVNTVSTWTVGAFIMAWDDPTQEKAEKSGAGFNWKKLLPAPLVGFLVALVFLLLKIPFIHVGWLGFAVNTLNYVGSLVTPLSLIYIGIILADAGLKAIRFDRDTIVALIGRFVIAPALITGLILLGMKAGFNVPSLEAQTLIIQAAAPGLAVLPILATEAHADVKYATNVVTTSTVLFVIVVPILMMLVQGLA

SEQ ID NO: 6606 - protein, 165 aa, Lactobacillus casei
MEITRHGTVITTNGNPTALGEKLPAFTVTDAKGQPVKTNDLSHRLTLISVVPDINTRVCSISTKHFNQDMDEFDDVDFYTISTNTPQEQQSWCAAENVTKMQLLSDQNANFGKAMGLFVADNHTDARSVWIVDGTGTVKYRELITEQTHEPDYTSALAYLEAHQA

SEQ ID NO: 6607 - protein, 169 aa, Lactobacillus casei
MQQTLVVYTSETGFTQRFALSIAQTLHCEVIDVQFLTASDLKNRTLIIYGGHLVGNKVLGLKSFFRQFKDMLPDMVIVFGSGVVRRDNVNCQQIKQYQFMHDCPVTSFYYVQGYPKLSQMNFLRRLRAIRALKHWGSESYPAVQEAIQPLVADVTSLLNGPFTHGVVQI

SEQ ID NO: 6608 - protein, 604 aa, Lactobacillus casei
MSETELPKRQAVDPKLTWDLTPIFHDDFAYGEAVKQVRALTKDFVRMYQGKLTEPAVIVDALADYGTIVALDSKIAHWGFMPYSTDTTDPKLRERQAQVTALGGEIGGQLSFFQAELTQLSETVLDAVVDKAPDYAGFIRQIKVAKKGALPPAAEKVLAELSPVFQAPSNIRDQTIFGDMDFGTFTAHGKTYPLSFVMYEENYQKHPDTEIRRAAYAQFNKTLRRYENTMAAGYLAQVTREKITATMRGYDSVIDYLLADQEINREMFNRQIDVIMHDLAPVMRKYVTHVKTLWGLDHIGYTDLQIDIDPSYAPTITLAQAQEMIKNATALMGKDYQDQMMQAFSDHWIDFPANQGKDSGAYTAGPYGVHPYVEMTWSNTLPAVYTLIHELGHTAQMVRSQQAHNVLDADFNDYLVESPSTFNELLLTHYLEETAKDPRMKRFALSRLLNDTYFHNFVTHLLEAAFQREVYTLIDNGESFDAARLDAIKRKVLTDFWGPAVELEEGAELTWMRQSHYYMGLYSYSYSAGLTVATQAFQAIEQQGQPAVDRWLRYLSLGDSLDPAAAARVAGVDVTTDAALKHAISFLGDTVDEVVALSKEIGQD

SEQ ID NO: 6609 - protein, 116 aa, Lactobacillus casei
MGIDNNQLVARYFDRKADHADFFKALETYLDDKLGQLYATLETTFADTVVLSVDDAIAQAHQAGATIDDPAAEEIAAANYLFKELASRGLWIQSPDQTEPNTIIAKLNFGNRRTYY

SEQ ID NO: 6610 - protein, 146 aa, Lactobacillus casei
MAEEQTLVLVKPDGVANGHIGEVITRIERRGFTIEALKVTQATTAQLHQHYAALVDKPFFPKVERFMTSGPLVAMVVSGFNVIEAVRKMTGATNPGDAAPGTIRGDFGREWADQTIRNVIHSSDSEESARREIPIWFADKQYAPKS

SEQ ID NO: 6611 - protein, 782 aa, Lactobacillus casei
MAAQNISPDQGLSAQQVQQRFESGQHNLPLKPLTRSISQIIQVNTFTLFNLVNVVLGALIITTGSYKNLLFLGVAIINTAIGTIQEIQAKRQIDKMSILAAAHATVIRDGQQQKIDLEQLVMDDMVLLKRGDQIPVDGTVVATNGLESDESPLTGESRPITKKVGDPLLSGAFVVSGQATMQVTAVGKDTFAAKLSLEAKAEKASQSQLLATINRIIRVLTYVLIPIGIILFSVSMIRRGNYNRAILTTSAAMIGMIPEGLVLLTNVALAVSARNLAVKRVLVRALPAIEALARVDTICLDKTGTITSGKLKVANTLPATGHNAEDVTSAAAAIVYALNDDNETALAIKAAIDADANQQVTQTMPFSSARKWSGAVVDGRALFMGAPQFTFGDQLPADIATQIKQAASNGYRVLAVGTVKALAQPLVNPELLGLILITDELRPTAINTFDFFKSQGVALKVISGDDPITVANIAKQAHLEGADRSVDMSTIAADATEADFQALVKQYNVFGRVTPDQKKQLIMAYQALGHTVAMTGDGVNDVLALRQSDCSIAMASGADAASSIADFVLLDSNFDAMTGVLNEGRRVINNIERVASMYLVKTMYSVILATIFVFLPLDYPIVPINLTPVSAIGVAIPSFFLTLEPNFERVTGQFMQKVMTVAAPAAISVVVYTLLLTWMESFLNLSFDTTSTMVAMLIGTISLNVLLVVARPFNRLKVGLLAGLSAALFLVFFIFNHVFSLASLWQWQLALIYVPLMVSTVPFYLLIQEFLGRRVLSKINWR

SEQ ID NO: 6612 - protein, 307 aa, Lactobacillus casei
MVKLNPNGTRFVTLPNGYHLWTQTQGQGQIRLMTLHGGPGGTNEVFENFAQELAPYGVRVTRYDQLGSFFSDQPDFADPANQKRFLNIDYYVDEVENVRQQLGIDHFYLLGQSWGGVLAIEYALKYGEHLKGLVLSSMIDNLDEYLVNINKIREKMFSPEDVAYMQQIEARHAFDDAKYQALVSELGEHYLHHAADPQPRHLISTLATPVYHYFQGDNEFVMVGALKNWDRRADIHRITVPTYLTFGGHETMPLTAAERMAQTIPHATLHVTPNAGHGQMLDNPTDYFSHLGQWLTQTDAKAPLSDN

SEQ ID NO: 6613 - protein, 115 aa, Lactobacillus casei
MASIDELKDDLFEPVHAFDKAIEEQPELMIPMAVVHLIPIALALGGGIMIIRGHQKLRIEKERTKQLSLKLQMHKHHHGRHNWRLAPEHRGAHDVFAPEYEEVPLNKKHHMHHRH

SEQ ID NO: 6614 - protein, 174 aa, Lactobacillus casei
MSTIFMRAATTNDIPDMMRVIASARKFLSDQGIPQWQGTYPDQAAIEQDVATGIGRVLEVDGKVAGLAALVVGPDPHYLRIDGEGWLADVPYLAVHRFALDGSIRGKQLSRVFFSNIMSEAYRRGFTDLRVDTHAQNVIMQHAITGMGFDFRGIVYMDEPVPERNAYEVRLTTG

SEQ ID NO: 6615 - protein, 384 aa, Lactobacillus casei
MQDIGNLALILVTTLILAHISRLLKMPAVIGELLAGILIGPALLGWLTPSHTVSLFAEIGVIILMFLAGLESDLDLLKKYFKPGMLVAVIGVIVPVVVVFGFAHVWGFNLTSSLFLGITFAATSVSISVEVLKELHALDGRNGATILGAAVVDDILTVLILSFTVAVLGEQKTASVPFWLQIVEQLLYFIGIYLVVRWAAPYLMGLAEKLFPASAVTIMSLLICLGMAYVADLVGMSAVIGAFFAGVAVGQTHYRQEVDSNLSAIGYAVFIPVFFVSVGLNMRFDTFGRDIGFIVILTLLALVTKWVGCGLGDRLAGATWLQSNVVGAGMVSRGEMALIVAQIGFEAKLMDAEYYSAVIVVIVLTTLIAPVILKDALHREQELV

SEQ ID NO: 6616 - protein, 223 aa, Lactobacillus casei
MATLFFDFDGTVADSEAGIVAGLKYMVQDRGLRPLDNSAYVQFIGPALVDMLPKVWPELDDVEVKRAIDAFHHYYEEEGLYQAKLYPKFLDTMTELKQQGDQLYIASAKPETMLHRLVKHFSLDQYFAGAYGASDDEQTRVTKTDVLAYALKATQTDPAVSVMIGDRANDMTGGLDNHVQLLGVTYGFGSAKELQDAGAKVLANKPEAIPEGLKKVAKLSAKS

SEQ ID NO: 6617 - protein, 152 aa, Lactobacillus casei
MTDKPLLEAYVDAYFSTFKNINELISEPMAQYHLSFEQYRILSDIANDPTISLTAIVAKRGVTKPAVARQIRVLRNLNYVTQSKFEADRRRNTLQLTPLGKQVEAAITKEASERFNEWVNALGVRKAKQFVKLLNEIGTKVIQPRQAAKKEQ

SEQ ID NO: 6618 - protein, 310 aa, Lactobacillus casei
LRKHKKAWLIGILSVVGIIVVGLIGASLYFYQYAFVPSKKSFLSGKESRIITDGKAWLKSVHKETWTQQAVGDKLKLVADYVPAAKPTTKTVVVAHGYMTNKEYMAPQIKMFHDAGFNVLAPDDRGQGQSEGNYIGYGWPDRLDYLKWINQIIKKQGKQSQIALYGVSMGGATVMYISGEKLPSQVKSIVEDCGYTSIIDELAYQAKSMFNLPKWPLVPAVALTATLKAGYNVFDASAITALHKNTRPILFIHGAKDTFVPTKMVYQNYRAATKAKKALWVVKGAAHARSFPDHPQVYAKRVVGWFNANW

SEQ ID NO: 6619 - protein, 157 aa, Lactobacillus casei
MTEPIRVLFISISGNTRAFAHRLADYAETQHQQNPDNPPIQLKEISEATQSDGETKPFFVMVPTYLDGGNGIDNGVKELMTNAMGDYLAEGENAEYCLGIIGSGNRNFNEQYCLTAKRYAKEFDAPFLADYELRGTPSDAQRIYTILTRVAANEAQH

SEQ ID NO: 6620 - protein, 274 aa, Lactobacillus casei
MHYTLNDGNVLPAVGFGTYKLNGTNGVRAMVGALNLGYRLLDAAFNYENEGAVGEAVRQSGIPRSQLIVASKLPGRHHRYQEAIDTIEESLYRAGLDYYDLYLIHWPNPKEGLYVEAWQALIQAQRFGLIRSIGVSNFLPEHIDRLIKETGVTPAVNQVELHPYFNQQTQREYDDAHNIQTVAWSPLGRGAVLKEPVIKQIAAEHGKNVGQVILRWDLQHRVLPIPKSAHLSRQRTNLDIFDFSLTKEEMTAIDQLSKPDGRLRDQDPAVYQEF

SEQ ID NO: 6621 - protein, 286 aa, Lactobacillus casei
VVKTRTQQWRAISRSWFAFFTMIFWVLLFVEAFSTGMMLTVGTPARTEHVIVKSKGLVQMTQSLNKELIDTANKNGATLNPQSTLVTIDDTQRLASKMVTASADNQMRVSLDTIKESIASRLQKAAADQGQNFDQKKVLTSLTAFLDREINQLVMSEGWGRAYPLLVLMTQTAVIVAAILMVIVLLIMLKTAHSWRRFLAVTGRSTYIMGYMGGFMAVLTTASPFLGAISARMPVNAELARDLLLAYSPLWQRVAGWTIVIGLVIAALSHFLPRPAVDESESVNAA

SEQ ID NO: 6622 - protein, 281 aa, Lactobacillus casei
MKRDKWLWLALLVVVLVAGAGWYWYNNQADTPPTKEETTIGRTATLYLHGYSGGAGSTNTLIRRAEGTGATKVLTATVAKNGKVHWTGDPHRVSKPIVQVIFQDNKNPDVVKLADWLTTINRQLYQRYGVRNVNFVAHSMGNMAVMFYAVRNQDQGKLPKMKHYVAIAGHFDGIIGMGDQPHQIKLAANGYPSPMDENYGELARLRDHFPKGVKVLNIYGDLHDGSDSDGRVANNSSRSLRYLVSTRAATYQEKEYFGRDAQHSALHENPQVAKAVDSFIW

SEQ ID NO: 6623 - protein, 215 aa, Lactobacillus casei
MALFQDLYFVTAMKLLLGFIVFVVQIKLTGKGNLAPATIVDQMQNYVLGGIIGGVIYNTDVSILQFVNVLLIWTLIVFSSKYLTNHNRWLKRAIDGEPLLVVSHGNIRVETATQVGLSANDLAYRLRTAGVKDLRDVRQAYLEQNGQLNVIFKGDETIKYPLILDGQIDPAALDAIDHDEDWLKARLAEQGYKPEDVYMASFLGGKVVIAPYDRD

SEQ ID NO: 6624 - protein, 153 aa, Lactobacillus casei
MGTTFFAYSALTHQDNWQNTLRYSIIIIGAVAIIAYLVYFLRHKRSNKYRDLLILVALIELLTIGIQIRDLQASRTATADSQAVATLLRSVAKQKQVPVNQLYANSSTVHTGMLVTIGKSTKRMYTVTINADNNSYQLTKTTLIVPQVQFVTK

SEQ ID NO: 6625 - protein, 377 aa, Lactobacillus casei
MTEEVKIKAPFRADLVGSLLRPERLKVAHQQLDIGEIQQDQELAIQHEAIDHIVKKQVELGFNAVTDGEFSRRYWHLDFFWGLNGYEKDDSWKYEHDFKGGINAAANVHLAGKVSFNPQHPFFAAFEYLKSIVPDGVLPKQTIPSPALLFRDHRSDNWPKYYDTFDDYLADIVQAYVDTIQHFYDLGDRYLQIDDTNWAYLIQNLKDTENDPKKHEHFVALAKLAHRVIKAVLVKLPEDLTVTSHICRGNFQSTFLFSGGYQYVADDIGDLPYDGLFLEYDSQRAGSFEPLPQLWNGDPNKRIVLGLITSKFPELEDEEAVIERINAATAYVPLENLALSTQCGFASTEEGNKLTEDDQWAKLALVQRIAHRVWADA

SEQ ID NO: 6626 - protein, 157 aa, Lactobacillus casei
MAKVESFTLDHTAVKAPYVRLITTEKGTKGDEISNYDLRLVQPNTAAIDTAGLHTIEHLLASLLRDRMDGVIDCSPFGCRTGFHLITWGTHSTTEVAKALKSSLEAIANDITWDDVPGVDIKSCGNYKDHSLFSAKEWAKLILSRGISDDPYVRQVV

SEQ ID NO: 6627 - protein, 230 aa, Lactobacillus casei
TMEMFAMILYINNERMEMBRANEPRTEINYDZMTPKNIRHLINLATVMVVIALIAVTIYWYDLGILSDVKVLQNYIAQLGLTGILFFVIIQIIQVVIPIIPGGVSTAAGVILFGPWFGFLYNYVGIAIGSFINFFLAQRFGKPLLTYLISEKTYDKYIGYTKNQTRFDRLFTLAIVLPVAPDDVLCLLAGLTKMTFTKFFWIIVLGKPITIFAYSMSLLYGGRWLIDLFS

SEQ ID NO: 6628 - protein, 198 aa, Lactobacillus casei
MYEYFEGTIQAITPAYIVIDVNGIGFRLLVANPYDFEAGKQMRIYVQLIIRDNDQALYGFESAADKRTFNQLLTVTGIGPKSALAILANVSSGGLATAIAQDDVKFLTKFPGIGKKTAAQIILDLKGKISADAEPSPAAITPTASDVAPALADALAALVALGYTQRAVDGITDALKAFDATTTDAYLREGLRLLSGRA

SEQ ID NO: 6629 - protein, 343 aa, Lactobacillus casei
LADANKDRLVSGDIDDLNEAQIEKSLRPRMLAQYIGQDRVKHQLQVYITAAKQREESLDHVLLYGPPGLGKTTLALVIANELGVNIRTTSGPAIEKPGDLVALLNELRPGDVLFVDEIHRLPKIVEEMLYSAMEDFYIDIVVGQGPTAHPVHFPLPPFTLIGATTRAGMLSAPLRDRFGISEHMAYYSPDDLSEIVKRSATVFDMAIDAEGAHEIARRSRGTPRVANRLLKRVRDFAEVAGKSPVDLQMVDHALDQLQVDAQGLDQIDRKLLMFMIRDYQGGPVGLSTIAANIGEEMATIEEMYEPYLLQIGYLKRTPRGRMVTPAGFAHMGMTAPEPDNRAQ

SEQ ID NO: 6630 - protein, 356 aa, Lactobacillus casei
VQDKKRYRQVENKNYQLSDFDYDLPHELIAQTPLKERDASRLLVLNADTGAMQDRHFYDILDYFKPGDALVMNDTRVMPARLYGVKPETGAHMEVLLLNNTSGDDWETLMKPARKAPVGTVIDFGDGLLKATVTKELDHGGRMIHFDYDGIFMEILDKLGETPLPPYIKEKLDDPEMYQTVYSKELGSAAAPTAGLHWTKELLKKVQDKGVKLVYLTLHVGLGTFRPVVEENIEAHKMHSEFYRLTPEAAATLNEVRDNGGRIIATGTTSIRTLEAIGTKFDGEIKPDSGWTDIFIKPGYQWKVVDAFITNFHLPKSTLVMLVAAFTGRDTILNAYKHAIEEKYRFFSFGDAMFIY

SEQ ID NO: 6631 - protein, 380 aa, Lactobacillus casei
MEPAVKYRLIHQDKHSGARLGELITPHGTFPTPMFMPVGTQASVKTMAPEELDTMGATVILANTYHLWLRPGPELIEEAGGLHKFMNWHKGILTDSGGFQVFSLADTRHITEDGVTFKNHLNGAKMFLSPEKAIAIENALGPDIMMSLDECPPFFESYDYVKKSVARTSRWAERGLKAHKNPDWQALFGIVQGAGFRDLREQSAKDLVSMDFPGYSIGGLSVGESKDEMNHVLDFTTPLLPENKPRYLMGVGSADALIDGALRGIDMFDCVLPTRIARNGTCMTSRGRLVIKNAKYAHDFGPLDPNCDCYACRNYSRAYIRHLIHVGEAFGIRLTTYHNLYFLLHLMQQVREAIANDDLLAFREDFFEAYGYNKEKAKNF

SEQ ID NO: 6632 - protein, 140 aa, Lactobacillus casei
LGNGNVSMIVLLVAFFAFMYFFMIRPQKKQQQKRQEMLNQLKKGDPIVTIGGLHGVIDSIDQQAGTVVIDSDGIYLTFNLNAVRGVASRPATPAPAAKSEEAANTDEQRAAKAADDTASEADSQAAASDDTTSEADNKQN

SEQ ID NO: 6633 - protein, 868 aa, Lactobacillus casei
MLKNTAKTATEVDVKQMIDELVANAHSALKIMKTFDQEKIDHIVHRMAIAGLDHHMELAKLAVDETGRGVWEDKAIKNMFATEEIWHSIKNNKTVGVINEDKQRGLVSIAEPIGVIAGVTPVTNPTSTTIFKSEISIKTRNPIIFAFHPGAQKSSARALEVIREEAEKAGLPKGALQYIPVPSMEATKALMDHPGIATILATGGPGMVKSAYSSGKPALGVGAGNAPAYIEASANIKQAVNDLVLSKSFDNGMICASEQGAIVDSSIYDAVKKEFKAQGAYFVQPKDMKKFESTVINLEKQSVNPRIVGQSPKQIAEWAGIQIPEGTTILIAELKGVGAKYPLSREKLSPVLAMVKADGHEDAFKKCETMLDIGGLGHTAVIHTADEDLALKYADAMQACRILINTPSSVGGIGDLYNEMIPSLTLGCGSYGGNSISHNVGTVDLLNIKTMAKRRNNMQWMKLPPKIYFEKNSVRYLEHMEGIKRAFIVADRSMEKLGFVKIIEDVLARRENPVQVQTFVDVEPDPSTDTVFKGTDIMRSFGPDTVIAIGGGSVMDAAKGMCLFNDAGDADFFGAKQKFLDIRKRTYTFPKLNKTKLVCIPTTSGTGSEVTPFAVITDSKAGIKYPLADYALTPDIAIVDSQFIESVPPVVVADSGLDVLCHATESYVSTMATHYTKGLSLEAIKLVFENLEKSYHGDIAAKSKMHDASTIAGMAFANALLGINHSIAHKLGQAFHLPHGRCIAITMPHVIRFNASQPKKRAIWAKYSYFRANEDYAEIARYLGLPGKTTDELVESYVQAFIKLAHSVGIKLSLKDQGVKKADLDKQVDRLAELAYEDNCTVTNPQEPLISDLKHIILDEYEGTESTF

SEQ ID NO: 6634 - protein, 214 aa, Lactobacillus casei
MTPNKEDYLKLIFEIGGDTELVSNKQIVAGMHVSAASVSEMINKLGEEKLVAHTPYQGIQLTSAGRKKAAILVRNHRLWEVFLVKCLKYSPDAVHQEAEKLEHALTPEMAKRLSAMLGNPEYCPHGGVIPDAEGHYIQQSRVTLGAMEVGQRGHIERLIDEVSLIDYTVKIDLRLDDAFTVTAKTLDAVVIKLDRTGKELAVDADRAAHIFVEL

SEQ ID NO: 6635 - protein, 153 aa, Lactobacillus casei
LTRKSTQLTLTFKPVAAPLFGQSADSKPDTLTIYIEPSEGYSLQLNGKALGTGLTIEPDELRYRHDPKAAAAAPEAYERLINNVLEGDQTNFTHWSELSASWHFIDAIQAAWSQEPNMPTYPAATMGPQAAFDLLSRDGREWFWQPHRVQMAD

SEQ ID NO: 6636 - protein, 368 aa, Lactobacillus casei
MALFELPLQNDTSRKIIHLDMDAFYASIEMRDNPQLRRKALVIARDPRTTGGKGVVTTANYVARRYGVHSAMPANEALQLVPRSELVFKTPDFPKYKAVSAQIHAFFHQVTDLIEPVAFDEAYLDVTANHAFPSTIALALWLQDQISQATQLTSSIGISYNKFIAKQASDYNKPNGRTVVLPEQALLFLDRLPIKQFRGVGKKTLPKLTDLGVTNGKTLRALSQDQLLGMFGKMGFVLYQHARGVDNRPVAVRTAKSIGKERTYGTPLTDSASVQTQLRKLAAMVVTSLNQKGMHGKTVVLKVRDVDFITQTKRLTQDHYFENEQDIFAAAWQLWQSVKLPKLAIRLLGITVTGLDPKQYENIDLPLG

SEQ ID NO: 6637 - protein, 437 aa, Lactobacillus casei
MATKHEQILDYIANLAVGKKISVRSIAKHLKVSEGTAYRAIKEAENTGFVSTIARVGTIRIEQKPLNPIESVTFKTLVDLIDANVLGGHAGMDKKLDKFVIGAMTPAAMRPYITRNSLLIVGNREDVQRLALEDGAAVLITGGFETSPAIIALADNQQLPVLQTAYDTFTVATMINRALSDQAIKQDILTVAAIYTPLSQIETIGVEATVGDYLAMTDPHYPLPVITRNGRLVGLMRPALAAGKKPTVPIERLMQKDPQTVKPYLSVTTVGHTMQDNGMNAMPVVDDSWNLLGIVTRNAVFSSLTGIAHSRELSNTIADQVSAQLTAITPQKPYGGGFELKTVPAMTNALGTMSFGVLAEAINSCTTRYLHASGRRNVLVEGVNLTTFRPVQLESIVTVLLRVLELTRHDATVDVDVLSDGVQVAKAVVTCQLLERN

SEQ ID NO: 6638 - protein, 318 aa, Lactobacillus casei
MIQTDIINAIKANNPIIIHRHVNPDPDALGSQVGLAEAIRAGFPDKQVYQVGSDTGNLSWLAQEQTISDDVYKDALVIVTDTADTPRISDTRFNQGKMLIKIDHHPNDDAYGDLTWVDNDASSASELIYDLIAASDGTLKLSDQAARMLYAGIVGDTGRFLFNNTTPHTLQVAAELIKKDFDPTAINNRMNTVTLAQARLQGYVIDHLKISPAGAASVTVPRTAIEDLKLADDQVSAVVGTPGRLDIVVAWAEFIEQAEGGYRVHLRSKGPIINTLAKAHNGGGHPLASGAKAANFDEVIQIETQLDQLVKDYSTSGK

SEQ ID NO: 6639 - protein, 481 aa, Lactobacillus casei
  misc_feature (6)..(6): Xaa can be any naturally occurring amino acid
DEADBXATPDEPENDENTRNAHELICASECSHBMENQFKQYQIKPFVIAGLDAMGITQPTPIQKKVIPALLRGENLVGQSQTGSGKTHAFLVPLLSMVDPEQDATQVVITAPSRELANQIYAVAQQLTQTEPAIRISRLVGGMDKQKQIDKLQHHQPHVAIGTPGRILDMIKRYDLVPASVRHFVVDEADMTLDMGFLETVDAIASSFPENLQMAVFSATIPQKLEPFLRKYMHHPTMIELKPQSVIADTVENILIAAKGQDKNELIYQLVTMGHPFLVLIFANTKTSVDAIHDYLKHQGLKVAKIHGGVQPRERRRIMKEVADLKYQYVVATDLAARGIDIKGVSMVINAEIPRDLEFFIHRVGRTGRNGMAGTAITLYEPGQEDQVAELEHMGIKFAPKTLHKGELVDTYDRNRRVHRKPKQEETSLAMRGLVKKAKQKHMPNYRKKIRTAALLERKRNAKVARREALLAEKRKNRKRG

SEQ ID NO: 6640 - protein, 311 aa, Lactobacillus casei
MAVNELTLPTWNTLNEKRQRFIFQQLTRYFLSPLLTVDAIRPVTATFYGQTLHTFEAMIGGEWVRLVPGMTNVSLGFAADLQEELAPYLAQSGLTLADIQQLLSPVRKTDMPPMLVATRATPANEEILGRVSLTTRIFKGNHMAYAAIRAQVLALLDRHGSLDPFSQTGWPATLTSGNVKLRLASAHHYQVSIVKSWRKADLSKSLSYFGFRLPTQDQYEYLQSGGNPSLFPFGNTLPLEMPRYLPNRFGLTIPVKRTGSELIVEDLQKSTALTAQPTAKEALALSPFYQVPGEVDLSSAVYRRVATITVN

SEQ ID NO: 6641 - protein, 881 aa, Lactobacillus casei
VKKMSSGEIRQMFLDFFKSKGHAVEPSASLIPVDDPTLLWINSGVATLKKYFDGSVVPDNPRITNAQKSIRTNDIENVGKTARHLTFFEMLGNFSVGDYFKKEVIPWAWELLTSPKWFGFDPKRLYVTVYPKDKVTKELWRKVGVPDDHIVEAEDNFWDIGEGPSGPDSEIFYDRGQSFNNVAEDDPENYPGGENSRYVEIWNIVFSELNHLPDGRFVEQPHKNIDTGMGLERLVAVIQGTPTIFETDLFMPIIKATEKMSAGKKYGANAQDDVSFKIIADHARTVTFAIGDGALPSNEGRGYVLRRLIRRAVLNGKKLGIDHDFLYQLVPVVGEIMKSYYPQILANQPFIQKVIKSEETRFRQTLDAGVNLLNQIIAELKKTGKKEISGADAFKLFDTYGFPVEMTNEFAQDEGLQVDMAGFKKNMAAQRDRARKARGDRQSMGSQDTVLMNITTPSKFTGWTELDHKHATLQDIIVDDQLQNDVSDGTAQLIFDETPFYAEMGGQVADHGQIKAQDGTVLAEVTDVQHAPNGQNLHTVTVNGKLEKGQAYWLSVDRLRRKKVSLNHTATHLLDQALRDVLGEHTHQAGSLVEPDYLRFDFTNFGQVTPKQLREVETIVNQKIWDALPITWKEMPIEEAKKLGAIAMFGDKYGDVVRIVSIGDYNKEFDGGTHPTNTNALGLFKITSESGIGAGIRRVEAVTSKEAYEYLTQQQDWLRETADHLKIDQVKNVPSKVAQLQADLKTEQKTVGGLQAKLAAQAAAGIFDHAETIGDFKIITKQVQVAGMNELRQLADEWKTKNASDVLVLGTEANGKANLLVAANATANKAGIKAGDLIKAIAPKVGGGGGGRPDMAQAGGKNPAGIGAALNEAKEVIGQQA

SEQ ID NO: 6642 - protein, 363 aa, Lactobacillus casei
MRALRLALTDFLGTREVYQVVCRDNLVNIDYIVDPTTLEGAAENELTGADAAAFIAKLSALDFNAWRKPSAEKSPMLADTRWELTITDDGGQKDRYEGGQPLPENFETLLSLLKYAVTVPGGHFLPPTAWQMDYVRFGTIQLPKFDGPGRFLNRQLRYRRTYLIDALNNQVVLKTAYAEPLSDHDVVYHDPELVASLAKKVTDAVAGLGDLTAITVDPAQRPRAILVLTVKYPHGEPTQLQVNAETDLKMKKLWQTVTAAIQNFRRIGERRDLQEAYQLGPQLMHYIKVNFRQGSKDYLYKTDLPGLQEGDVVIVPVGNEGRTLHGEVVDAQVMPPIHFPVHPDKIKQVIGLADWDDEDDDWV

SEQ ID NO: 6643 - protein, 86 aa, Lactobacillus casei; identical to SEQ ID NO: 2258

SEQ ID NO: 6644 - protein, 144 aa, Lactobacillus casei
MRLMGLDVGSRTVGVAISDPLGWTAQGLEIIRINEDKQQFGIARLKELVKQYEVTAFVLGLPKNMNNSIGPRAEKSQAYGDLLKETFGLPVDFIDERLTTVEASRMLIEEADASRKRQKQVIDKVAAQMILQNYLDAKGPLTKQ

SEQ ID NO: 6645 - protein, 106 aa, Lactobacillus casei
MANNEHVTPGDDNQQITLIDEKGNEELYQVLFTFDSEDYGKSYVLLYPASESDNQEVEIQAFSFTPDANGDASSGDLFPIEDDEEWDMVEEVLNTFLADDDSNLQD

SEQ ID NO: 6646 - protein, 44 aa, Lactobacillus casei
MAKAQPFNLKATYAPVSNRAGSRSHKKQTTNSGGLLGGMTWLIL

SEQ ID NO: 6647 - protein, 81 aa, Lactobacillus casei
MTEEKRRFKAVIGGKAYTIIGPGSEQHFLTVTKLLNERLDQVKTLAPDLTAEEQAVLVAFNAVSDQVKLLAAQQDEPDQKA

SEQ ID NO: 6648 - protein, 177 aa, Lactobacillus casei
LISIAIILVLAYFYYSGERRGAALQWLHVGGYALSFLAATALAQPLGEHFTLLIPYPSATNAGQFAFYSDKIGLTLDTAFYRGFAFLLVLTIGWLMTRIISLWFHDLTYKAMGHRRSAVIGGIANLVIGYIFLFLILALLALIPIAGIQQGLDHSIVAKVMIKYSPGLTQFVNALWL

SEQ ID NO: 6649 - protein, 786 aa, Lactobacillus casei
MNKKILKTLEYDKIQRALLRQVVTAKGRQLVQNMVPLTDPVAVQRALDETADGASALRLKGGIPVPQLENIDPALKRVDIGAVLNGQELASISRVLQTVSAIDKFLTDLQDQIDFRQLYTLQEELTALPQLSRRLKTAVDPDGTLTDEASPELHGIREQIKRIESDIRNKMSEYTRGAQSKYLSDPIVTIRDDRYVIPVKAAYRSKFGGVVHDQSATGQTLFVEPQAIVALNNRLREAQMAETAEINRVLAELSNELAPYTGQIKANAAVLGHFDFINAKAKLAKNQKATEPLVSSDNDVLLRQARHPLIDRHQVVGNDIPLGADYQAMVITGPNTGGKTITLKTLGLLQLMGQSGLFIPADDESRIGIFDEVFADIGDEQSIEQNLSTFSAHMDNIVHILKQLSRNSLVLFDELGAGTDPQEGAALAIAILDAVGEIGAYVVATTHYPELKLYGYNTPKTINASMEFDSKTLQPTYRLLVGVPGRSNAFDISMRLGLPQPIVDRAKSMISSDSHELNNMISDLERQRKAAENARAAAQRQLADAQALHDELADAYKTFTTERDAQLQQAKEKANAMVDKAQAKADKIIKQLRQMQLTNPGSVKENQLIAAKTALKRLHQDEPLQKNRVLRREREKQALHVGDEVKVASYEQTGTLLEQFDKDHWQVQMGILKMKVPTSELEKVKPTKQASAQRPVVKVSGGGMSGPSTTLDLRGERYEQAMADLDQYIDAALLAGYPSVTIIHGLGTGAIRNGVTQYLKRHRQVKSFGFAPQNAGGSGATIVNFK

SEQ ID NO: 6650 - protein, 103 aa, Lactobacillus casei
MVQAVTDSNYKTETDTGVTLTDFWATWCGPCRMQSPVIEKLAESRDDVKFVKMDVDANPETPKSFGIMAIPTLVIKKDGKVVEKLVGYQTKDQLDATLNKYTA

SEQ ID NO: 6651 - protein, 506 aa, Lactobacillus casei
MIDNVITAIDRVAAEHPTRVAYDYEGKQYTYAQLKDGSDRLAGFFAETLPDGQPIIVYGGQTFDMVEVFLGLSKSGHAYIPIDTHSPNERITQVQDVAHAPAVIEVAPLPITVPDVQIIKAPELHDAEKTHEPIRSLQHAVTGDDNYYIIFTSGTTGKPKGVQISHENLLSYVNWNISDFGLQEGVVSMSQPPYSFDLSVMDLYPTLVLGGTLKALPKEVTDNFKDLFATLPKLGLNEWVSTPSFVEIALLDPNFKQENYPNLTHFLFCGEELVNKTAQELITRFPKATVYNTYGPTEATVAVTGMAITQEIVDQYPRLPIGYAKPDTDIFIVDEQGNQVPPDTEGELMIVGPSVSKGYLNNPDKTAKAFFKVGSKRGYRSGDLATMTADGMIFYRGRTDFQVKLHGYRIELEDVDHNLNQVSYIKQASTVPRYDKDHKVAQLIAFAVAKPNDFDSDMKLTQAVKAELGKMVMEYMIPQRIIYRDQLPLTANGKVDRKALIAEVNH

SEQ ID NO: 6652 - protein, 405 aa, Lactobacillus casei
MLNLQPYENPQYFLYLIIALLPVIIGMFKGFRMHWYESIFSLVFLVLIFDADKWPQGKALLGYVVFNLLLVYAYFKYRTREGSKNSTAVFYLSVALGIAQLAVVKFTPLFQHHGSILGFLGISYLTFRVVGTIMEIRDGSVKDLNMWKFVQFLLFFPTISSGPIDRYRRFVKDYDRVPDPEHYAQLVTKAMHYLMLGFLYKFILGYIFGTLWLPSVEHMAMASRGGAFLGLSWPVVGVMYAYSGYLFFDFAGYSLFAVAISYLMGIETPMNFNKPWMSYNIKDFWNRWHMSLSFWFRDYIYMRFVFFVMKHKWLKSRVSTAFVGYLVLFLIMGIWHGETWYYIVYGLFHAMLINLTDAWLRFKKKHKDFFPHNKATHYFAIFMTANAVCLSFLIFSGFLDTLWFH

SEQ ID NO: 6653 - protein, 81 aa, Lactobacillus casei
MADESIKNGVLDILADLTGSDDVKKDLDMNLFETGLLDSMGTVQLLLELQSQYGVNAPVSEFDRKEWDTPNKIIAKVEQAQ

SEQ ID NO: 6654 - protein, 423 aa, Lactobacillus casei
MKKPIGKILWRGLGPLLIAVILVAALMLVPFKFGSSSQATIRQAASSMSANVLKGENIKNEAMAENYVPFIGSSELSRMDALHPSVLAQKYHRSYRPFLMGMAGTQSLTHFLSVNALTHANGKKAVMVLSPQWFVPGGVRKAQFDFFFSPAQLTTFLLHANPNSEADRYAARRLLQFPSTNSDRMSNGALKNIAAGQKLSDAQYWYLKQVKSPMADHQDALFSQLFLNNNQPKLNKAAKQLPAKYDVDDLDGVATQIGMKDTTNNPFGLKNDFYSKRVKKNLPKLEGSQAHWSYVKSPEYSDLQLVLNTFAKKHMEVLFVIPPINAKWAAYTGLDMNMIQDTVTKLNYQLKTQGFNHVLDLSQDGAQPYFMEDTIHIGWRGWLKMDQTVRPFLKTNKAARIHYKLNDQFYTKSWQQRSANGLD

SEQ ID NO: 6655 - protein, 160 aa, Lactobacillus casei
MAKSDYTTLLNLPGSVSFFAVTAMRDLMLPNMLGEEQHHILYWAGRDLATKLPVDETALPQLFTQVGFGTLTPLKQKRQERQYLLAGDVVATRIRTYDDPDFQLEAGFLAQSLQQVLGFAVEGGSAIQRRDQNVVLTVVMDNQDSQPTADHLIDLAPDDQ

SEQ ID NO: 6656 - protein, 484 aa, Lactobacillus casei
MNKQPIGFIDSGVGGLTVVKEALHQLPAENTVYLGDQARLPYGPRPAEQVQAFTWQMVNFLLTKHIKMLVIACNTATAAALPLIKAKLSIPVIGVIKPGSRAALKATRTGHIGIIATEGTVKSGAYTQALRTKAPDIRLTSLAAPKFVSLVESNEAHSPIAKRVVADTLQPLLHTDIDTLVLGCTHYPILRPIIQNVMGSGVTLIDSGAETVNDVSMLLDYFDLANDSHETPTHAYYTTGAPSMFDELGEAWLELKAPMHAQHVNIESEPTHFVDMADITNGKTIVVASKNPGKVKEFKAMFEPAGVTVKSLADFPSVPTVDETGTTFEENARQKADQYAKDLQLPVIADDSGLMVDALDGQPGIRSARYAGDGHNDAANNAKLLANLADVPDDARTATFHTTLVLAKPDHPEADLVVHGDLSGQITAIPRGTDGFGYDPFFLVPSLGKTLAELTAEEKNQISHRGNAMRSLEKVWQAWLEEEI

SEQ ID NO: 6657 - protein, 172 aa, Lactobacillus casei
MKILAVSDTHGDREILATILKQQPDLDGYFYAGDSELPADDSLFQTYHAVEGNMDFDPNFPMSVTTTVKGITIFMTHGHRFGVNFGLDKLMAAGEAAHAQLVIFGHTHQLGVEERAGMVILNPGSISQPRGQFTNLGGTYATVSWTEDKVHVDFLKRDGSIVAPLSRDFLQA

SEQ ID NO: 6658 - protein, 243 aa, Lactobacillus casei
MTYDLGVRLAAEFIGTAIMVLLGNGSVANVDLKGTKGNGSDWLLIAVGYGAGVMIPAMMFGAISGNHINPAFTLGLAASGMFPWSEVLPYIVVQMAGAMVGQLFVVAAYKPHYDLTTNTQHILGTFSTISATKSKLNGFVNEFIGSYILFIGALGITKAPFFQDNLGTAHMGLGFLVATLVASLGGPTGPALNPARDLGPRILHALLPLKHKGSSDWGYAWVPVIAPIVAAILAVFTYKQLFM

SEQ ID NO: 6659 - protein, 161 aa, Lactobacillus casei
MLNQAIANMLIENRHHFMISADMVATVSEDNPLSHAFLVLTKVRYAKIPVLDHDSKFKGLISLPMITETMLGLDHISFQSLDTMTVKDVMETDVATISDPYDLENVLHLLVDNPFIPVVQDGYFTGIVTRREVMKGINNIGHNIDKHFQLEPLASVVEKES

SEQ ID NO: 6660 - protein, 301 aa, Lactobacillus casei
MLNFIKGAIIGIALVIPGLSGSIFAVVVGLYDRLLQAVNHFRANPKKNLRFLAPIGLGAVVGILVSTKAVLVVTTHWPLPSYGFFIGLVLGIGPFIYRKLVLKPFTWWYLLLVAGGFAGIYGLAKIGGTQPENLIAIQRLSSVSDAGVMAFAGIFAVSLMAIPGISGSVMLMVIDQYGTVYNAVSQLGDAARAFASGNWSAFNAAMGSVALLLPFMLGAIAGLIAVAKLMAYLLEHFETQVYYAVCGIVAAAVVILLETGIAPYWPATGMVIPALLVVVSLIIGVLATIFLDKPESNADAN

SEQ ID NO: 6661 - protein, 294 aa, Lactobacillus casei
VTGMMFTATAVTEQPNVWLRYFKIINWDKIAGTVIDKVLSLLFFSILFLALYRLGQFAINRAFKSYQRRAHLSGTRVKTIHTLSRNLFFYFVLFFYFYAILSTLGVPVGTLLAGAGVAGLAIGFGAQGFVNDVVTGFFILLEAQFDVGDVVQLGKISGTVTSLGLRTTVVKSYDGTVNFIPNRNITIVSNLSRSNMQVLIKLPLEPTADLDLVRKTIERVNHDLVPKFTTITEGPDILGLTEEKNGTFTYQVLFYAENGEQLSLQRTFLAAYIAALNSAGIHVITPPINLQSGS

SEQ ID NO: 6662 - protein, 142 aa, Lactobacillus casei
MSGGEIAWIIAAVAFLIIALAIAVIAIRVSGVTKEVKETVAETNKTLNTVNGELGILTKEIEGLLAKSNTLLEDVNGKVAAIDPVFTAIGELGESVSDLNQSTRNLTERVAHGAKNGAKATVATRMGAKAFSMLTKKKHHNE

SEQ ID NO: 6663 - protein, 168 aa, Lactobacillus casei
MAKKGHFLLGFVFGAASALATTYLLTPQTSDELKRRVKHASANLADRAVDYYDYAKEASADWKQSATDFVDDLKARGNDADGSEALANYDAATEQLRDQLNTAADTDTSADFDDIVLDGKSAFAQAKDDDEGSETRTDEVPEPTEPKPVSGAAASEAKPASSESEATD

SEQ ID NO: 6664 - protein, 173 aa, Lactobacillus casei
MLNSERQAHIKATLSTAAEPLSASSFARRFTVSRQTIVGDIALLRAQGEPIIATPRGYTLSHPAAHEFLIPCKHTPEQTEEELQLILDNGGWIEDVLVEHPLYGQLRGQLNIRTVADMKLFLSRLARYQGRLLSELTGGIHLHTISVRNERNIAKIKEALRKAGILYEQSEAD

SEQ ID NO: 6665 - protein, 367 aa, Lactobacillus casei
MNEHLAALQTWVGEEGLDLAYISDPVNINYYTGFFQDPEERITALIVTPDKDPFLFTPQLTIEEVKKTGWPYQVFGYLDHEDPFAVMATHIKDVNPNPTKWAIEKDNLAVFKFEALMKQFPDATFPIDASRFIEKQRLIKTPAEIKQMEIAGAQADRAFQAGFKAIKAGATEQEVAAEIDYAMMKEGVMHMSFGTIVQAGVDAANPHGEPMGTKLAPNELVLFDLGTDNHGYMSDATRTVAFGQVTGKPREIFDICLEANLTAMDAVKPGLKASELDKIARDIITKAGYGEYFNHRLGHGIGMSTHEFPSIMEGNDMILQPGMCFSIEPGIYVPGVAGVRIEDCVHVTETGCEPFTHTSKEFTVIKG

SEQ ID NO: 6666 - protein, 333 aa, Lactobacillus casei
VEKQTITIYDVAREANVSMATVSRVVNGNPNVKPATRKKVLEVIERLDYRPNAVARGLASKKTTTVGVIIPDVTNMFFSSLARGIDDVATMYKYNIILANSDENNQKEVSVLNTLLAKQVDGLIFMGHELTDSIRAEFSRSKTPVVLAGSIDPDEQVGSVNIDYVAAVEEATHQLLESGNKRVALATGSLTHPINGQFRLKGYKQALEKAGVAYDESLIFENEPSYQAGLALFGKLQKVGATAVIAGDDELAVGILDGALDKGVKVPDDFEIITSNNTKLTEMTRPQLTSIDQPLYDIGAVAMRLLTKMMNKEEIEEKTVMLGFDILKRGSTK

SEQ ID NO: 6667 - protein, 916 aa, Lactobacillus casei
LKKFVDRVKTLGTRFRRWFTAFVTRRPDSKADSKHLTGKTAVVFYGNVTLQSIKSIVYYLLGVLGIAAVFGLGLFGGYFVSIIDATPIPTEAAMKATLSNTSRTSSMYFAHNVKLSDVKSDLYSTKVSLSDMSPWLTKAIIATEDEDFYRHDGVVPKAVIRAFFSDLTGMGNQTGGSTLTQQVVKMMFLNSETTFKRKAAEIMLARRLNNHFSKNEILETYLNVATLGRNNKGQNIAGVEAAAQGLFGVSASQVNLPEAAFIAGLPQSPFVYTPYTADGQLKASLKSGINRQQTVLFRMYRAGVISHKQYVAAKSFDLKGAFLKPENAEQDDNEYGYVYNMVLSEAKSLLAEKLAQNDGHSAADLAKDNALNNDYLRQAGDLFASKNYQIKSTINKDVYDRMQFVMRATRNTFGQTYTSTQINPKTGETETVKHPVQNGSVVLDNQTGAVLGFVGGVSGELNHIYTLRSPGSTIKPLLVYAPAIDQKVIGSQTALADFKTNLGNNYSVTDYGDQIQNRFIPATEALAQSYNIPAVNLYKHIKPNVNVKSYMEKMGIDTLTDNDYSQLGLALGGTDYGVDVKEQASAFSTFANEGEHVPAYVISEIVDPSGHAVYRHHVKKTKVFSEGTNYIMNQMLKNVVESGTAESLNYQLRFNTDNLIGKTGTSNDFRDIWFIGSTPGVTIASWMGYDNSNGTNYTLDENSSMTNEAYWSKLANAVYHTIPKQFKVDKKLARPSTVKSVTVDKQTGQPAGTLTFNGRTYHTGGSTVTSLYNDWQPTAKAEFGIGGSKDNYQLFYDHLNGKSNGYGQVSDANGRSTEAKKEHQETPITPETTTPATTESSQTPSVTVPSSQKNQQGTSENQPSEPQTTGTGGTNGATGTGGETTGTGTTTTGGNTTGGTTTNNQQTTPATTGSGQ

SEQ ID NO: 6668 - protein, 227 aa, Lactobacillus casei
MYRVILFDVDDTLLDFKAGELKSLAKMFARLKLPYTPRIEASYLKINADLWRDYEAGRITRPELFDVRFAKLFRHHHLNADPHLAERTYHHFLDQEAILLPRVTETLDALKDYRLFIVSNGIEPVQRERLATSGLIDYFEDIFVSDSVGSPKPTVAFFDYVAKRIPRFNRHETLIMGDSLTSDIQGGINGKIDSIWFNPHFQPNREQITPTYQLNEFSDLTKLLLAN

SEQ ID NO: 6669 - protein, 248 aa, Lactobacillus casei
MLTPDSLNPWLDDPHLRAAVTTQATVTSTNTVLKQTVQNGATLPQILIAGEQTAGVGRHGKHFASPADAGLYLSYAFHPQISRALITPAAGIALQQAIETQFGIATAIKWVNDLQKNGQKVAGILAEALLEQNAVVLGVGVNIFPTPTAPLPTDQPITTLLTEKPGSDPRPEFAGRFLTNLMRLFANPDTIMPIYRKKAAWIGRQITVSGTQNPLTGIISGFDDNGALLLKTAQGTMVVTTGTIRLAD

SEQ ID NO: 6670 - protein, 467 aa, Lactobacillus casei
MAINWQQEAEKLEPQLLSDLTTLLKINSERDTEHKTAEYPLGPGPAKALDAFLAIAERDGFKTLNVDHVAGRIELGSGSEIFGLFGHVDVVPAGPGWKTDPFDPVIRDGKIYGRGTSDDKGPSIAAYYALKLIRDLGLPINKKIHFILGTDEESDWVGLHRYLESEPAPDFGFSPDAEFPIINGEKGIASFKIVQKPVAAAEAELTLNEFSAGIRPNMVPQEAKATITGDLPESFATQVSDWADQQGVKLTLTLGNPTTIEIVGKGAHAQEPKDGKNAATYLASLLADLPFDPAGKAYLTMVAKYLHLDSRGHHLGINYTDKLMGELTASPDIFTFTQDGEQSVLVNVRYPQGTDADKIRDQIESAVGADQFDVSLSGHAQEPHYVPGDDPLVKTLLQTFTDHTGIAGHEQVIGGGTYGRIIKRGVAFGAQMPGQENVMHQANEYMPIKDIITAVAIYADAISRLVK

SEQ ID NO: 6671 - protein, 446 aa, Lactobacillus casei
MGKRFTVAVLLLPLFLLLSGFTLVGHRGDPLNYPEETFQSFDSAFNNGADYVELDVHESADGVVVIQHDSTIQRMTGANLTIAKSTFAQLQQYHTKNGEPVHSLEELFAHEQQTNHKFLIETKIVKGEPHPHLEDKITALIKQYHMENRVMFHSFSAASLKRLQADLPSVPRILIVGSLKRINFDVLTYVDGINLSSDLVTPQLVNQLHDLGKKVYVWDEMNEDRDRWTWLVNLNIDGVVTNYTSLGHEFQALKAAAVTTSINDLGANSSTSALPVYENPYQPLLRPEQLAPQTPIAISAMVTVAGSTYYQIGDNAFVPATTINLAPQAGWASLFLHQKIVVTSRGFRAPVYADPLHQQNVTGHVADNTRARVLAARYENSRLYLKTKAGWLKAKDVQLLPTAENMATWLMLYRSIPLKEKPLIHWALGNTAFDTPLLNARVTDIG

SEQ ID NO: 6672 - protein, 104 aa, Lactobacillus casei
MAEKYQVFDLIQEITRLDGSRYFELGNVMLNGRAEKASMKGFIKRVRIVQLNIAHSTAVATYEKYINEHYEFPPADLTSWEEWDKPEGPIRDAYHEILRQNHVG

SEQ ID NO: 6673 - protein, 355 aa, Lactobacillus casei
VKYLGKWLIPFVAAIAVFIGMQFDSGFYTKPVGQVEAVKVVKTTTHQDEDENRDRMVKQQVQIRLLNTAKRGKRITMHNTYSFSGALDNELRVGEQVFLDVDKGAYTLNNVKRDAILAALLVLTFGLIFLVMGRRAWLTSISILLNTLIFFIAVEWEIGSKQWQAWWLFVILAVIFTVLTAVFIVGIKPIAATISLGALLATTVAVALGYGIMALTNYSGIHFEEVKYATQTPQLLFFGQIVIGSLGAVLDEASDISVAIFQLHDTAKERFRAGMAIGRNVMGPLISVLFMIFIADTFMESVLWIRNNNSIAQTVIWVMGLGFAQSLISAFGIVLAVPVTSGIAAMMAKIKKVTA

SEQ ID NO: 6674 - protein, 246 aa, Lactobacillus casei
MNAILALALVLLVMMFIVGGKQGLSNFFALAVNALLMILVVILMASGFNPIIVAIIFGLIILASTIFLSTSQLSVAGPAFVSSLLIMTLLVGLILLTMTLSQTAGFGPEDSEALEGFSVYIGVSFPHILIATTLLGTLGAIAEAAIAVAAGMDEIKDQASATGIKQMGHEIIGTALNTLFFGFFGGFSSLFIWFASLRYPFSQVINNKIFVGELLQVLISVIAVILTVPMTTWVVTTRHAHRRKEQ

SEQ ID NO: 6675 - protein, 200 aa, Lactobacillus casei
MQYFIADTHFFHADLLGNNDFAPRLFPTVEAMDAAMIQAWNARVDDRDIVYHLGDIAMNPEHFPQPPEVLAILLQLHGRIVFIKGNHDYESLFKFLHRHDPGVNGLPKFTFHSVGTIIKDDHTQFIMTHYPLMMGIVKQTLNLHGHIHHNSVNIAENINVGVDAPERDLLVPHLPFGTPLTAAEVHKIYRLKAAALAKER

SEQ ID NO: 6676 - protein, 458 aa, Lactobacillus casei
VEKLVILHTNDLHSHFENWPKIRRFMLGTRAAEQAEGASVLAFDDGDAMDRSVPLTEATDGQINIQLLNEIGYDAVTIGNNEGVGNPHQVLEHLYDHANFPVALANLFEPDGTRPHWAKPIVMKQTSAGTRIAIVGFTAPFFLTYQPNGWQVKTVADVFPAILKKLEGTYDVLIVLSHLGIEADRHLAQQYPQIDVVIGGHTHHLLAEGELHGTTLLTAAEKYGHYVGKITLTLDDDHKVQTRRAETFQTALLQGAAADPREIQGYESKGIALLKQQKVARLPKHLAIQYDRPSPLLDFGLAAVADAAKTDAAILNAGLFLTPLGPGVVTQADLLTCLPHPMHLLKVTLSGKELWRLIMEMEKNRMFLRHFHMIGMSFRGKIFGDIGYRGISVNREKRTVLWHGQPLVPERQYTFATVDNFLFIPFFPTIEIMGSNEFLFPKLIRQVVGDYMAKVFPL

SEQ ID NO: 6677 - protein, 208 aa, Lactobacillus casei
LGEREALSEQIDVALTPDITKEMRVVKVDHDLITIDGRRYRIVKDHRDAFDLERLNERYNDILDKYDFIVGDWGYDQLRLRGFYKDDRRGASKDQQISTLEDYLYEYCNFGCAYFVLARLDKPATKLVDRRHDRERKSATGKTAHRQQSKTTQRQHHGKRKPYAKANKPYTEKTTRSPHFHGEQAKTVNQTQPRKRHFTIRQRETNKK

SEQ ID NO: 6678 - protein, 258 aa, Lactobacillus casei
LKYKGYMIDLDGTIYRGKERIPAAKDFVERLQAAQLPFLFLTNNTTKSPEDVVKNLAENHDIHVSPAQIYTPSLATAAYLTDLNHGDVSGKSVYIIGELGLKQALLDTGLRLNEVDPDYVVVGLDYDVTYHKFELATLAIKRGAKFIGTNADTNLPNERGLVPGAGSLIALVERSTQQRAFYIGKPEPTIMEKALKKMGLPKDAVAMVGDNYNTDIKAGLNAGIDTILVYTGVSTRDYVSKQVHQPTHQIDALTDWEV

SEQ ID NO: 6679 - protein, 210 aa, Lactobacillus casei
MKRIVHWLTLWLAIVSGVIFVTIFSTLLTFPIYAHMDNLPQIAAMSLGRLYHNYLQLMAYLDLPWIGTLHMQDFPTSLHGALHFADVRHLFILDIVIAIVTIPFAIRWVHQLKAARKRYLLVRPFMIGAVVPIILTGLLSINFDRFFIIFHEVLFRNRDWLFDPATDPIINVLPEGFFMLCFLTAFALFEAIMIWGIWRGRQDARRQSPF

SEQ ID NO: 6680 - protein, 217 aa, Lactobacillus casei
MTQLFDFILHIDEHLITIVNSFGPWTYVILFAMVFIETGVVVFPFLPGDSLLFAASALAANAAYNLNVWILFAVFLAAAVLGDTVNYEIGKRVGSAASTGKGWFGRLINRDKLLQAEAFFDKHGGKTIAIARFMPLIRTFAPFVSGGSRMHYGKFIHYNLLGGFLWVTLCVLGGFYFGNVTFVKEHFSLVALGIVLISLLPMVIAAVKTRTAKVVDR

SEQ ID NO: 6681 - protein, 167 aa, Lactobacillus casei
MTNEEKLYERTIQLLHERGVSLSDIGELVMFLQERFIPNLTIEEATQNVRIVLRKREVQNAVMTGIALDKAAEANQLEEPLQKIIAEDEGLYGVDEVLAFSIVNVYGSIGFTNYGYIDRIKPGILAKLNAHEPGIIHTFLDDIVGAMAAAAASRLAHSHPEIEDDIY

SEQ ID NO: 6682 - protein, 340 aa, Lactobacillus casei
NADPREDCTASEMSVQHVYEITVIGGGPVGMFAAFYAGLRQADVLLLESLDELGGQTGNLYPAKILYDIGGFPHVSGKDLVSQLKTQLMHFHPDVKTATEVQTIDEAEDGTFILHTSQGDFRSKAVIVATGGGAFTPRKLAVDYDPALEGRQLFYFVQDLETFRNQDVAIAGGGDSAIDWALALEPVAKHVSLIHRRAKFRGLEASVAALEKSSVAIHTPYLIEAVKQENGKLALQLKEVRGDNEPVLTVDKLLVNYGFVTDKRHLQAWHFKTDRNGILVDSQMQTSRSGIFAIGDAVSYAGKLPLIASGFGEAPTAINEALSRLYPERRQALHSTQLYR

SEQ ID NO: 6683 - protein, 194 aa, Lactobacillus casei
MDYPQLELADFKGPKAIFKTSEGQFEIALFPEQAPKTVENFIGLVKKNYYDGVIFHRVIEDFMIQGGDPTGTGMGGESLWGKPFADEFSNQLFNLKGALSMANAGPNTNGSQFFIVTNSHLDPSMKAQLSEAGFPEPIIDAYQQGGTPWLDHRHTVFGQVLSGMSVVEKISKVKTGANDKPVEPVTIDELTIQD

SEQ ID NO: 6684 - protein, 119 aa, Lactobacillus casei
LTGKVTGVQPYGAFVMLDEHTQGLVHISECQHGYVKDTSDIFTVGQRVEVVILDIDEYTHKISLSLRALQAPPRLSKKRRRKHYWTSRKFHTGFAPIAAHLDGWVAEALEHLNEETTQK

SEQ ID NO: 6685 - protein, 64 aa, Lactobacillus casei
MDIVILIGGALFVLGMLIAAVNTRIDYGFFTHYRSVNRGVNLIAILLIIIGLGIVILKFMANGQ

SEQ ID NO: 6686 - protein, 180 aa, Lactobacillus casei
MKQVEIELIREAVNDSAAFGKLFAQYRPLVLTVLKPYHLRDFSYDDWMQEARIAMLKAVVRYDGSSGSQFGPYYRMVLKSHLRSVLRKHFAHKRRIDANAIPVNDTSLESLHDRLAIRSVEDGLLMRVEFLQFLESLSPLEYEAFEAAILYPSKKPMLDRHRRALERARAKILKFSREDE

SEQ ID NO: 6687 - protein, 566 aa, Lactobacillus casei
MEKSALNYKSHFIRRVHIIASKGKNNKIGLFQLVMLALGSLIGSGWLFGSWEAAAVAGPAAIFSWIIGGVIIGVIAYNYVELGTMFPESGGMSKFAQYSHGSLVGFIASWANWISLVTLLPIEAVAAVQYMASWPWQWAGFTRGFLKAGKITPEGLLVVFAFIIIFTLLNYWSVTLLTRFTSFISIFKIGVPLLTIILLAMSSFHPENYGHSFATLMPYGSAPIFAATSVSGIIFSFNAFQTVINMGSDVKRPQKNIGRGIGISLLISGVIYILLQSVFITTISPNMLATHGWKGLNLNSPFADLAILLGIHWLSVLLYMDAFVSPFGTGVSFVASSGRALQAMVGNNHIPKFIGKIDEKYGTPRVAMVVNAVLSMVMVSIFPSWGTLASVISTATLIAYLTGPVTVISLRDMAPDFKRPVKSARLRFMAPLAFVLTSLAAYWAKWPTTVEVIGVIFLGIPLYLFYEWRSGWRSTWQQLKASAWMIGYLIFLSVISLIGSREFNGLNWIHYPMDFVVIVIGAIVFYFWGINSHIFSKYFRRARRVNAKVKMPPSDDSTHAEQTAKR

SEQ ID NO: 6688 - protein, 402 aa, Lactobacillus casei
VNIGIFTDSYFPQVSGVATSIKTLKDDLERKGHQVYIFTTTDPHVPDDAVEPNLFRFTSVPFVSFTDRRIAVRGLFHAYAVAKELNLDIVHTQTEFSMGYIGKFVAKQLKIPTIHTYHTMYEDYLHYVLNGHLLKPYHVKQFTRAFLYHVSGVIAPSERVYDTLRRYGVKTQIKIIPTGVDLTQFAEQKDPHLREKLGLADVPVLISLSRVAYEKRIDKVISAMPAILAQIPNAVLLIVGDGPAREDLETQAAELGIADHVRFTGEINHDDVGDYYRVGDVFVSASDSESQGLTYIEAMAADRKVVALAGDYTDHLLDDPALGTTFSTEAEMVHQVVNYLRHPNAYDDPKPRAEKLAAISADRFGDRVLDFYRDVISHYSPNEADESAPWTDESTSKRTMKG

SEQ ID NO: 6689 - protein, 342 aa, Lactobacillus casei
MIVINMFSSANKVAGQGVGAVYTELMGLLKHDFANEFQINVNRYTRSDISHYHTIDPKFYASTFSKKRGRKIGFVHFVPSTLDASLKLPRVARWTLDKYTLAFYKRMDELVVVNPNFIPKLEAYGISPEKVTYIPNFVSQRTFHPVSAEKRQALRHANGFKPDDFVIFGAGQVQDRKGVGDFIKLAQKNPDFRFVWAGGFSFGRITEGYERLKQAVANAPANLDFTGIMPRETMIDYYNMADLFLLPSFEELFPMSVVEAFATGTPVMVRDLELYQQIITPYAITAADVDDMQARIRALADDRELLATYATKSHQAAQVYAESRLEKIWHDFYVKQAALGKQ

SEQ ID NO: 6690 - protein, 339 aa, Lactobacillus casei
MTRKNKLAVLIMVLIGAGIFIYEARDLNGAKLVHELLSLDLKWLLVAFLLMFGSWIVETFVVQIFIKNGTDTLDFKTALRVPLVEQLFNAITPMASGGQPAQLFALMQSGVEAGRASSVLLMKFVVYQFMVLINFILTLVIGFDQVSRHFGALALFIVFGFVIHVIVIVGLLMVMYYYKFTKRLVRLIMVPVGWFVKPERKLAMQTDLDHKIDTFYAESLHLKREKVRVIKACLLTLVQLLLYYAVPYFVLLALGVNHVSIVEVIVLHVMIVMIVSLFPIPGGAGGAEYSFKTLFATYVASPSKLVLGMLLWRFLTYYLGMICGIIAMALPPKKSDKVS

SEQ ID NO: 6691 - protein, 390 aa, Lactobacillus casei
MILQPLNEQLPAIEVSEIRQFDESVSKIPGILKLTLGEPDFNTPEHVKQAGIKAIQENYSHYTGMVGDPELRAAAQHFFKTKYGTDYDAADEILVTVGATEALATAITTISDPGDAILVPSPIYPGYIPLLTLNHVTPIYIDTSKTDFVLTPELIEATIAANPDAKIKGIILNYPSNPTGVTYHAAEVKAIASIAEAHDLYIICDEIYSELTYDATHISMGRYAYDRTFVVNGLSKSHAMTGWRIGFLMGPRHLIAEAKKVHQYLVTAATTIAQRAGIEALTNGADDAQVMKAAYIKRRDFVYAALIQMGFEVARPDGAFYLFAKIPERLHMHSREFTQALANEQKLALISGTAFGPGGEGYIRISYAASMDDLKEAVKRLRAFIASRTA

SEQ ID NO: 6692 - protein, 91 aa, Lactobacillus casei
MKQSQLVAIIKRLEAMQTGDGETQSRRFEKNGDEKGLVTYDPKTETYELEELGTHQTFQFDNIDLAAMEIYDLMDFDEDEDTNDTNDSDQA

SEQ ID NO: 6693 - protein, 698 aa, Lactobacillus casei
MNQIGTKLRGFFNTRLGFLALAIVLFWAKTYWAYQAKFNLGVTGSFQHLILAINPIPTTLFLFGIALYMSGRKSYVTMLVIDSLTSVWLFANVLYYREFSDFLTFALIKGSGAVSNNLNKGIMGIVQPTDFLVFVDVVVLILLLAFKVIRMDIRPIKKRFALGVSLLAVLMFGANLAMAYSDRSGLLTRTFDNNYIVKYLGLNAYTVVDGVKTAKNSATKANADSSDVKSVLNYLNKNRVAPNAEYTGVAKGKNVFIIHLESLQQFMIDFKWDGQEVTPNLNKLYHESDTLSFDNFFNQVGQGKTADAEMMMENSLFGLPEGAAMVTDGTTNTFQAAPAILDQHGYTTASFHGDVPSFWNRDNTYKSWGYDYFFSKNYFSSGKNYDVGYGLKDKIFLKDSAQYIEQLPQPFYAKMITVTNHYPYTLDKANQTISKTDTGDDTVDGYVQTARYLDEAMGEFFNWLKETGLYDKSMIVLYGDHYGISNNHKKAMAKLTNISGFNDYNNAMYQRVPFMIHMPGLKGGINHTYGGEIDALPTILNLLGVKDNNTVQFGSDLLSPNHPQTVAFRNGDFVTPDFTKVGSQYFNTSTGKKISKLSASQKKTVDAATNRVTTELSLSDRVINGDLLRFYTPSGFKKVDRSDFSYKLTDTKKKLKAAQKDGTSLKAQNKGKSTVDEYKTDAPELKSSSDDDSSDDSK

SEQ ID NO: 6694 - protein, 153 aa, Lactobacillus casei
MNQAVYNKTINLLKAKQIRVTPQREAIISYMIDSTAHPTAEMIYAKLSPQFPHMSVATVYNNLRLLVDLNLVEEMSSNDAATHFDFPIEPHYHAICTNCGKIFDFTYPGVTDVEAVAAKETGFKVSGHHLEVYGICPDCQVKLGMKPAKQHTK

SEQ ID NO: 6695 - protein, 631 aa, Lactobacillus casei
VQSQSREGNRVSRRFFVILFVFSLLVSALAFTSSKAATTSADKSIPMIGLNSNDATITDMNGHDVTSEPKLSKDFIYTLNYHWRVPDQIVIAAGDMAKVNLPATVVIQTDLSFPVKDPKTGAVIGKFSAKAGSQTALLTFTDFFSHSTVGRTGTLTFTAQGTYDDHEHHQVGWYIAKSGWAVLPPANASAAEKAQYVDSLGRPKILQWEITVNPQMVQVNHLVLNDTLGSGQTFDATRKIQVETGSYSQGAFHQSGTINPNYQITGNQIKIELGNIDQTIKIDLWTNPNPTSFAQTTTWTNQVSAEGQNQGSGLPTNAKGKIVWTDNGSGNGKVGQVTLTKRDQDQPKKVLTGAVFALYRANHTLVHANLTTDTQGQLTVRQLLAGSYYFVETKAPNGYERNQTPLPFTINIQHPQVTIQANDQASVTPPPVKPSTSSMPSASASKPSESGSRLPSTSSKPSTPVSDPSTSTPKRPSTSSEPSTSVSDSSASRPKGPSTSSEPSTSVSNPSVSRPKDPSASSEPSTSVSDSSNSSSKLPSTSSESPTSVSSSSTSRPKYPSTWSEPSTSISDSSNSSAELLSKSNNQPGGTNHSQNQRRLPDTGERLKIAAAMLGSFLTLIGVVLFVKVRK

SEQ ID NO: 6696 - protein, 124 aa, Lactobacillus casei
LGVKWVKRVLTIAGIFVAMLFMLLFPIQKAVAADDDIPPDSGIPDSALKAPDYFFKSTAKPEYNQNRSSFSTTYPQALIVTGSANYQNWQIGGMWRNSGLILTAPLPTRLLITLVRGLVMMQTG

SEQ ID NO: 6697 - protein, 714 aa, Lactobacillus casei
MTFTLQNDPEGIAAYGAPGGGLGAYPWSRSGPPKQELISHYIQNALSIEMDSYWSGDTAQFDDMYDYDYPNTKMTGHLGVVRPGETPLTTKTSRDVGHLQYVPLTDATKLSNGKFRPFTVKWTPSVTYKDGVRILGGDLQYYMDGNPAEGSIFRINNVLDYFKSDKVLFGYTGSSGTHPTFQAVALLKMPQNAQPVTVNFVDTAGNAIQDPLTIPGDPGNQWDAAKRRPEWIHKGDDWYQYTGKYTANTPDQKDAGTFSATVPYTVTYQYEARRPPLSYVLKKAVRNDTAGETDFKTSTNAKDGDLVTYELTYTNLLGGTTGSIKDQLDANHTYQNGSLQMANADTGGAFKPYTAAEENFKTNHTIPFPYTIKDGDSFKIRFTAKIARQDTAETILNQASVGGSGSDQITSNQTTIHLPATTGKVTFSYVNRASDMAKPEVIAPEVTVTGKIGQKVSDVDASAIRPKAIKDWTVIDQASSSDLTQATFDQAAVVDPVFNKEETVITYRYEKPMLKLTVDPSLDFGDFDTNSVDRTYYIGENQAKTKQKLPFGVTIEDYYGVSQWQLSVQQNGQFTSEVKPDSQNPDLHVSHTLDNATLHFLNPRLQHTMVSGPAWAQQDNLIYKAPDDFALDPTATKSTVLAAIDKRGHYLKDDAEQAEATGTQYDNSGASTWRLNFGDADSAPTSVGLHVPASTKRYQAHYKTTLTWNLSMLP

SEQ ID NO: 6698 - protein, 345 aa, Lactobacillus casei
LKWKKSWYGMLLILGLVFFGTVPQRVFAENESEKTDFEVQPVLPDAQTNTQLNYFDLVYPKDSTHTIQMRVQNFSDKNITVASDLRNAYTQDGGGIEFTPKTSDLDPSLKHPFTTVATLDRGSATIKLAPKQMKVITATITMPKTNYDGMIYGDWHFIERVDKGKSGSTAIGSNYAYSVGVVLRGQNYEVFPDVKYDETKPILFQKHPALGVTLRNVEPMAISQAKVNVSIGADQGEVRTYQASNVMIAPNSKMVFPVSWSYDEMKPGTYHIKATIKGLSTYNRFPVNWTFKKTMKVTTSQAKTVNERAIKKPVNHWLYATIGSGVLLLASSGALLWVLKLRPKS

SEQ ID NO: 6699 - protein, 348 aa, Lactobacillus casei
MKRRLRCQQLAFIAMLLACLLFSGYQIKTAVAAVNTPQQTLMVAPVIPNDNQVKKAAGYYELQLPKIEDRTITVQAYNASAKALTVGVSILDAQTGTNGVVQYVKPKQVNRQYLTIAGSDLVKTPAQITLAPGETKDVPVVLKASKARPKGTYLSAIHLIALTPTDTANVRQRIAYTIGLVLHQGRDSQSLKALRLKQTSLVKRSSGFQLRYQFLNPERHFLKDATASVQLTNASSRFFSLKMQQPLSRIAPQTQFVMTHDIQGQKPVSGQYRLVAEIKQGRHLKTITQYVRITGDGKLIAGSRIAFRLAQQKWNLLKVAIVIVVLGIIGFVLFRWRQHRKAKKSAEI

SEQ ID NO: 6700 - protein, 51 aa, Lactobacillus casei
VQALITRFSYRRVKWFLIGLTIILLIAFVICLSLTIKTYNDFNTWKTVNLF

SEQ ID NO: 6701 - protein, 300 aa, Lactobacillus casei
MFKVTKMTSALATGALLLSGLAIATPAAVQAATVDGNANVNGGQALPQEGKTTAGISFGQTAPSGNTGYLRLQMVPKILDFGNHESFVSEYPVFTADGINAGNATNNRYPNYKSGDTNLTAILNTDDKALSAVKGKVWTTVVDKQTTRTDAENKLDASGKTDSKAGSWTLNVKADSPLTLKNDNGGDTGKTIDDATLTFTNTAYGQTGSVYALTNEVQDDGFTPVGPLTPVADIAKTTTLNLGTNDTSHQVAYAAPEQGEGANVFAWDKKNIKLVLPKTAVVQNGIYEASLTWTLAYGLN

SEQ ID NO: 6702 - protein, 215 aa, Lactobacillus casei
LKKFNQNAYAAAFIGQVLAYPFLIATGLQISWNFQLIALLLMTLCLAGTGLVKRYDLMLLLAAIMGILGAINQWLLLPLIVVQLVITLLLRTQKMPSQWMNTVIFGQALLAQVIIIYACLHFFNRTMLLDLALLYLPALIGLWAVHLPKWADLILLLVVGAIGYFQQRMNLIAIAGMLVVALAISSRRSFKLPAYSYQFSPLVLALLLYLTRLHG

SEQ ID NO: 6703 - protein, 394 aa, Lactobacillus casei
MQERHLFTSESVSEGHPDKIADQISDAILDAMLEKDPDSRVACETTVTTGLVLVVGEISTNAYVDIQSVVRGTIKKIGYTKESGFDPDSVGVLVALDEQSPDIAQGVDESLEARESDTDPLDKIGAGDQGMMFGFAIDETDTYMPLPISLAHALMRRTDKLRHNGEISYLRPDAKAQVTVEYDDNEQPIRVDSVVVSVQHDPDVTLEEIRRDVEAKIIRKIIPADMMDDDTKIYVNPTGRFVLGGPQADSGLTGRKIIVDTYGGFARHGGGAFSGKDATKVDRSASYAARYIAKNIVAAGLAKRVEVQLAYAIGVAKPVSVSVNTFGTNAISEQLIEQAIRENFDLRPAGIIKMLDLKRPIYEQTAAYGHFGRTDVDLPWEHLDKVQALLKYRD

SEQ ID NO: 6704 - protein, 497 aa, Lactobacillus casei
MKQRKTNVALVTTAIFIGTFMTAIEGTIVSTAMPTIIGSLHGVHLMNWVFSIFLLTNAMATPIYGKLSDKIGRKPVFLIGLTIFVIGSLLSGLSQSMIMLIIFRAIQGIGAGAIMPVTFTIIADIYPFEKRAKMLGFNGSMWGIASVIAPLLGGFIVDQLSWHWIFFINVPLGLLTFGIVWFFLQEDRRQVRQPLDVRGTAWLLIALLALMYGFQALAEPNALWQIAGMAIVAAFGFWQFWQAEKHAIDPIIDLKLFENRTFVVHNLIAALISGFVIGFEVYMPMWIQGILGMDASLGGFAVTPSSLMWVVGSFVAGKLLGRLQPKPILTGAMLWLLGGSLILALVPQSTPYFVFLLVAGGLGFGFGLVITITTVTAQAIVAPDQVGVATSFNTLSRTLGQTLMVSIYGIVLNLRLTQGVAADGRLNSNMLNELINPHTARNLPAAVLPTLRQILYEGLHNIYFFSIVIVALALIANHFEAKKVLSKEATQETDEEA

SEQ ID NO: 6705 - protein, 163 aa, Lactobacillus casei
MGLFNERLRSLDISLGIGETSRVTGATPTQIRYWEKKHLIHSLRHEANGNKRYSLSNIALIVMIKSMLDEGYTLAKASEEIEKSHQKADKLHVLMSTRLQGIQYDDDQTFLNFGPLENDPGFDVVAVVQENTAKLYKKAIQPPMPPHQGSLPENKDATGRSTL

SEQ ID NO: 6706 - protein, 492 aa, Lactobacillus casei
MDVKDINGKQVNVPMMVITLIVGTFITVLNQTILSTAFPTLMKAFDISTATVQWLSTGFMLVNGIMIPVSAYLSAKVPSKWLYMSAMGTFFVGTLVAFVANSFAILLAGRLIQAVGVGITMPLLQNIMMSIFPPNRRGAAMGMAGIAIGVAPAIGPTLSGYIIDNFGWRVLFGMILPIAGLVIIAALFFFKNVLPLSNPKLDVPSLIESSIGFGALLYGFSEVGNDGWGDPMVLGSIAVGLIFIVIFGYRQLHLKEPFVELRVFKSKIFALSTVLGTIANMAMVGVEMILPLYLQIIHGKSALESGLTLLPGALLIAVMSPVTGQVFNRIGAKRLAQLGLFLLTIATLPYFFLTTNTPSIFITVIYAVRMFGISMVMMPLTTNGMNALTPDMIRHGTAVNNTVRQVATSMTTAVLISVLSNVTNLTKPAASLVKSNPLQYKQDFFNATLNGYHAAFLLAVGFSLVGWILTFFLNSHAMSQEVTIKDEKKVKA

SEQ ID NO: 6707 - protein, 241 aa, Lactobacillus casei
MILWFLGLMVVGLYLSFIMMHRSLKRTALIIVFGIGVVGSLLLITLNDNAHFGMVKRTTTDEQTIYTASPNAQMPMLLKQTVGTAGKHAVYIYKTDPKKKAVHTKADLAVHNKVSRTSDTSASLTSKTTRWEYQNGFYGALFNHEGADQFVSQHNQLAIPKSWFVLTTTQAKQLSTKLKALQHPTAQQKAALATKVKAKAAELVKADPKLATDQTTLMKQAQKAVQQELIQQDVQDVQAHK

SEQ ID NO: 6708 - protein, 224 aa, Lactobacillus casei
LAQRRSLPLYLSGSALIIFITLLVGIVNNANWIHTVDQRVIAFVTQFHAATLKPLLLVITELGNPSILIVLTMVLAAGLLICRYRSAAVFTASVGAIMGVLNVSIKYLIQRPRSFIADPQIRALVKASGFSFPSGHSSGTMMFYGTIILLAWTLLKHPTGKWLITILAVLMIGLTGYSRIFVRVHYPTDVFAGFSLGFALLMLSWWFFNPYLSRQHQRKQKADR

SEQ ID NO: 6709 - protein, 46 aa, Lactobacillus casei
MRGSESRRWCEPDDAKTELAFEVAAVKPVIAAGRTVISFERCANRT

SEQ ID NO: 6710 - protein, 803 aa, Lactobacillus casei
MAYDHHEIDKKWQRYWAEHNEFNTTTDPKKPNFYALDMFPYPSGQGLHVGHPEGYTATDIVARMKRMQGFNVLHPMGWDAFGLPAEQYALNTGHNPRTFTKQNIETFKRQINSLGFSYDWNREINTTDPNYYKWTQWIFEQLYKHGLAYEAEVPVNWSPDLGTVVANEEVIDGKTERGGFPVIRKPMRQWMLKITAYADKLLADLDDLDWPESIKQMQRNWIGKSTGAQITFAVTDSQEKFDVFTTRPDTLFGATYVVMAPEHELVEKITTPEQQAVVDAYVEEAAHKSDLDRTALDKEKTGVWTGAYATNPVNGEKLPIWISDYVLATYGTGAIMAVPAHDDRDYAFAKKFGIEIKPVIEGGNIDEAAYTGDGVHINSEFLDGLNEQDAIDRMISWLEDKEIGHAKVNYKLRDWVFSRQRYWGEPIPVIHWEDGETTLVPEDELPLVLPEEVDIKPSGTGESPLANLTDWVNVVDKNGRKGKRETNTMPQWAGSSWYFLRFVDPHNKEALADYDKLKQWMPVDLYIGGAEHAVLHLLYARFWNLFLYDIGAIPNKEPFQRLYNQGMILGDNHEKMSKSKGNVVNPDDVVDEYGADTLRLYEMFMGPLDAGIAWSTKGLAGARKFLDRVWSAFIDDEGKLRDRITTINDGRLDKVYNETVKKVTEDYEALHFNTAISQMMVFINSARKDDDLPLEYVEGFVKMLAPIAPHLMEEIWSRLGHDHSLTYAPWPTYDESKLKTDTYDMMVQVNGKLRGSITANVDESDDDIKQAALANENVQKFTAGKDIKKIIVVPRKIINIVAK

SEQ ID NO: 6711 - protein, 74 aa, Lactobacillus casei
MASINQPPNNYKHKLTPPKQSPSFQTIPDYYAKSVFKHLLTWYHINNCVIDNYQSFLLIHQRNPGKIASEAWIA

SEQ ID NO: 6712 - protein, 547 aa, Lactobacillus casei
MENLLGSGNQPPRSDKEKMIRGSAWMTAGSVFSRILGAIYVIPWRIWLGAAFLTANALFTKGYQIYSLFLIISTAGVPGAVSKQVARYNAMGEYKTGMRLFYHGTIAMLLMGVLSCGAMWLLAPLLAAGDARMIPVFRSLAWPLLLIPSLSLIRGFFQGYNEMAPSAISQFVEQVARILYMLVMTYAIMVAGNHHYLDAVVHSTFAAFIGAVFGLGLLVVYFVQQKPRLDALEAQSKQALNISVNEILLDVVRQAIPFIIMDSTINIYYIIDQYTFNPMMKAFYRVSEDQLDRFYALFAGNANKLIMIIVSLAVAMAITVVPLLAGAKTRGDVAGLARQITNTLQLFFIVMIPSAFGMVAVARPLYVLFYRDMDWLGIRLLQWSSILAILLGLFTVLAAILQGLFNNRLAIQEMLVGMAVKVIAQWPMIFFFDVYGPIIATMLGMTVSSLLMLYSTNRMYNIHVRQTIRRGIGILAFSLIMCAVCYLIVNLSGMIINPQSQFGAALVLLVAVGVGVLIYGYLILKTRLADMIIGERVSRLREILHIR

SEQ ID NO: 6713 - protein, 236 aa, Lactobacillus casei
MRLDKYLSHLQFGSRKEVKALIRDKRVRVAGELVTDPGYNILPGVAVEVNDAQADGPLEVDYLMNKPAGVITATEDPVQPTVLDLIRPHDYRPGLYPVGRLDKDTTGLLLLTTDGNLGHRLLAPNHHVAKTYTATLAKALTDDMKRQLEQGVVLEDFTTAPAEVTVVPATDNKVIQMTITEGKYHQIKRMLLAVDNEVLALTRIAMGPLRLPENMAAGDYRALTDEERAQLAQISQ

SEQ ID NO: 6714 - protein, 274 aa, Lactobacillus casei
MKQLTEQLAQAIVRPRQRNTYKGSFGKILIVGGNAQFGGAAIMSASAAVYAGAGLVSVATDPVNRSALHARLPEAMILDAASSALETAIRQATVIVVGPGLGTDNAALAILKRVFAAVEQTQVLIIDGSAITLVASHHLDYPNAQLIWTPHQVEWQRLSGLALPDQTVTASQQAASHIPGIVVAKSSQTHVFVGDDVYENMAGGPAMATGGSGDTLTGIIAAFAGQFQPLKQAVLAAVFVHSHVADIVAMNSYVALPTMVIRELPAYLKQLSES

SEQ ID NO: 6715 - protein, 166 aa, Lactobacillus casei
MTHKTHRAFGCYGIATIDQRLIVIRKNGGPYIHRFDLPGGSLDGPEPLEHDVLREFNEETGLTTTIDRQLGATSFVYPWQYEHWTINQHICVFYTLTITGGQLAKTVPQFIGQDSLGAQAVPLEKLTWDNASPLVMFAKSFLQTGQADLTTKTFSEWTVLKEGSDS

SEQ ID NO: 6716 - protein, 67 aa, Lactobacillus casei
MATKSFQTDFKFTSKTASALANALQQSKRVDVELTQKVRHYSSTDLSKTTKFDSFFGSGHERTKVGP

SEQ ID NO: 6717 - protein, 208 aa, Lactobacillus casei
LALDLVSLNGIIKKYPEEQVRESLSSFTSINKDVENFLHERCIEFEKISLARTTLVFSSYKGRSVLVGYFSISSKPLTISKKNWRGLSKSVQRKLMPMGYRTEQENYAVSSILLGQLGLNFQYHDTHLITGAELLSLAYKTIKIANEVVGGLVLYVEADDEPHLREFYTNNGFSQLVVKHPDNSNNGHTHPYLTANGQHLYTKKISDL

SEQ ID NO: 6718 - protein, 157 aa, Lactobacillus casei
MSIYDFDATLEDGAEYSLSKYKGQPLLIVNTATKCGFAPQFDGLEKLYKKYKDQGLVILGFPSDQFKQELADGHAAAEACRMKYGVSFPMHQLIKVNGAHTAPLFKYLKTEAPGELGKSIKWNFTKFLVDRDGRVVKRFAPKTTPEAIEPALKQVLA

SEQ ID NO: 6719 - protein, 401 aa, Lactobacillus casei
MEELPADVAAFVDAHLVDRRNSNAVKWDGLKEEFGRDDLLPMWIADTEFKAPQAVLDALTARVQEGTFGYSIRPQSYYDAFINWQKERHGVTVEPEWMRFGVGVVKSLYAMVNWLTDPGDPVLIMQPVYYPFMNAIKDLGRRVVSVDLQLTADGWRMDFDQLEKTLATTHIKAMILCSPHNPVGRIWTRDELNRLFAITSQHDITVVSDEIHGDLEVSGPKFTSALQVAEGKARQNLVVLNAPSKTFNLAALLNSHIIIPDEELRAKYDDFIKQLHPVDTSLMGQVAGEAAYRHGAAWLDQVLQVVRFNYRQLLDGLAQAAPKATVADLQGTYLAYVDIGAYVAPDHIKAFVEGICGLAVDYGAWFSPKTATYIRLNLATDPKLVAKAITRLTEHLSQPQL

SEQ ID NO: 6720 - protein, 442 aa, Lactobacillus casei
MKVVKYFAALLGMVLFAFVLSQVHPDHNAPLINDTHANIWVLSDTHFIAPSLHDERTAYTEIKKSAAGKDMDYQPVAIHALVQSALKARPTALIITGDVTFNGEKASAESLMRRLQPLVDNGTKVLIIPGNHDIYDGWARAYKGKQQLMTEQISPSDWRQIFHTSYAQAAAQDSNSLSYRVNLNHQYQLLLLDSNIYTIEPSNRPPNTGGKLSPQTLSWVRQQLAIGAHAHRKSIVFMHHNLYNHNEAVNEGYVLDNSDALKKLLTKYHVPLLFSGHIHAQDISRDPTGQCPTIEVVSGAFSISPASYGIVSFSPNKITYQKKATDLTPYLTSAQRKNPDLLHYQRYLKRLFLQDGEGLAYGDLMDNGVTNEHDLDAAARLMGILNWRFFTGDDHPSKAELKRLHADPGWAVLERSPKLRRYLKTIVQDHNLNDQHLVIKHP

SEQ ID NO: 6721 - protein, 88 aa, Lactobacillus casei
MQVIVTVIGTDKVGIIAQVTTALADLNVNILDVSQTIMRGAFTMMLLAKIPDDASFKSVKQHLTALGDKIGVEIKVSRQEIFDAMHRL

SEQ ID NO: 6722 - protein, 447 aa, Lactobacillus casei
METQQIKETIEMISEENLDIRTITMGISLLDCVTGDLQTTADHVYAKIMRKAAKLVPVAEAISDEYGIPIVNKRISVTPVSLLAGADPTLDFRPVAKAMDRAAKDLGVDLIGGYSALVQNGSTDAEIALMKSLPEVLATTERVCASVNIGSTRSGLNMDAVKLMGTVVKQVAARKPQNAMKLVIFCNAVEDNPFMAGAFWGVSEGDVAINTGVSGPGVVQRALAAEPRASFEGVCETIKQTAFKVSRMGQFVGKVAAERLKVPFNIVDLSLAPTPAKGDSVAQILETMGLSHVGTPGTTAALALLNDAVKKGGIMAAERVGGLSGAFIPVSEDANMITAAANGQIGLEKLEAMTAVCSVGLDMVAVPGDTPDTTISGMIADEAAIGMINNKTTAVRVIPVPGKHVGEQVEFGGLFGTAPIMAVNNGDATQFINRGGRIPAPIHSFKN

SEQ ID NO: 6723 - protein, 355 aa, Lactobacillus casei
MFVALDENNRRITLTSHQQARQLAGGRFHCPLCQQRVFIKNGVVLPAHFAHRHRPVGEGEPESAEHLAGKSWLATWLRQHERSATLEYYDAAIRQRADILIHQQPPKVLEFQASPLSIPDLKKRTTMYHRRGWQVSWILGRRYHDSQGKRQARKFLTLENDRLTLWYLNVQIGTLSRLQLKETGRLWTHYAHDHSPSQQWQSESVDGYRQARQIALSLQKRAHPWMSLQALAYERRHNLQGAPWVVHNQPHPLQHFGVPELRLRIQWLLTFEGRSFTAAQSRRFWVSALPDVWTPLLPAGTLARALDTHWLALIKDAGLIGFDGSRYRWRQLPQWFADIDRKLANITRLSGKDCG

SEQ ID NO: 6724 - protein, 211 aa, Lactobacillus casei
VLEIFLFFNPIGSICLSTEQKLLHQLDKFQQEVKVHFVPVLNLDIIEQFMQYEQLNVHSLAKRNQLLRAAYNLALDYKAAQYQGNKKARMLLLRLQQHAPLVQYQYDAAFVAKMLTKCHLDHEMFYEDRQRTEVKMGFDSDQRTANQMGITQTPSLVIVDTDRAVDDGHAVLIEQISDADLIPQLCDLIRTDPARFFTEQPENMGGHFRFF

SEQ ID NO: 6725 - protein, 212 aa, Lactobacillus casei
CYTHDMAINPRTEINMAISREQEFKTCLTKTAFLAILNHFEFDPAFSQMNTYYDTADGAVKAARLGLRIRQFADHAEQTLKVPNNSQHRDLQEITDPLTSMEAQNLIERGELKPGQVTQALAARHIDPASVHPQTQAKTTRRLAHLPAGLLTLDQTFYIDQTSDFELEMEYQNLDEAKKFYDNLLQNFHIKKQPVINKVQRAYEHVHDSQAK

SEQ ID NO: 6726 - protein, 225 aa, Lactobacillus casei
MQRDWDSFLMPYEQAVGELKIKFRGMRKQFQQANEHTPIEFVTGRVKPVSSIIEKQSRRFISDELLEQDMQDIAGLRIMCQFVEDIYQVVDLLRQRTDMKIVEERDYVTNVKPSGYRSYHVVIEYPVQLIHGEKKILAEVQIRTMSMNFWATIEHSLNYKYNGEFPDTLKARLKRAAEASFMLDKEMSDIREEIQEAQHLFVYGKGQQPYPDATDEKKPDSKKDE

SEQ ID NO: 6727 - protein, 265 aa, Lactobacillus casei
MRVTVFHNSIPASITAAQKLIKLLKNGHFELDERHPDVVITIGGDGTLLSAFHRYADQLDTIRFIGVHTGHLGFYTDWRDFEIEDLVIALKEDSGQSVSYPLLDVRAMYADATSAHYLALNESTLKRLNGTMRTEVYIKGDFFESFRGDGLCVSTPTGSTAYSKSNGGAVMHPRLDALQVTEIASINNRVFRTLSSPIITAPDEWVTLEPTGRDDYVMTVDQFVINPPTIKQIRYKIAKERIHFARYRHMHFWDRVEDAFIGAKH

SEQ ID NO: 6728 - protein, 300 aa, Lactobacillus casei
MRFEWHYEGPPLKLGAFLRQQGFSRAQLKKLHYQGGFIFVNKRQRNTAYGIRTGDRILVQTAPEQAADSVVPYPHDLTICYEDDDYLVVNKPAGVASIPAIGRKNDSMANMIKAYLIKTHAESQAVHVVTRLDRDTSGLMVFAKHSLAHSLLDRQLHSEGFLKQYVAIVTAKSPLPAHGWIVLPIGVSQGFYMRRIVSTTGKPSATEYRTLAQNSQAAAVLVTLHTGRTHQIRVHFAAIGHVLFGDDLYSRQRVSFERQALHCAHLHFWQPLKKQWLDLRAPLPKDMAGLAERLQLSLRG

SEQ ID NO: 6729 - protein, 359 aa, Lactobacillus casei
MKRGLRMMRKFFIGIIAFFGLLTLSGCQKKAQPTYLKTPYTQNEFVMGTTCTLTIYDKGKKSALKDGFDMIHHVDDEATLTRGGSVLDKINDNAGIKPVKVPKDFMPLLEKAYYFSKNSNGSFDMAIGAVTNLWQIGLPGARVPAQSEIDQALPLVNWRDVKLDSKNNTAYLTKKGMRLDFGGIAKGWVADKVREVLRKDGVTAAIIDLGGNVVVMGHSPLGAKRDWHVGIQDPTAARGTAVGTIPESDESIVTAGTYEQYLISHGHKYIYLFDPKTGYPYDNNLASVTIVSKKSVDGDALSNAAFDKGLKDGLQYMNAKNDQHIQAIFITNDKKIYLTNGLKKQFKFDADSGYHKGNF

SEQ ID NO: 6730 - protein, 211 aa, Lactobacillus casei
MLREVAVENYTHIPQALAAGADRIELNDNLAVGGTTVSKGVMAESAKYVHEHGRSLVTMIRPRGGNFVYNDTELKIMEADLFEAQALGVDGVAFGALTADGLIDEDAMTSLIAASAGMSVVFHMAFDAIPEDQQPAAIDWLAAHHVDRILTHGGPLTTPIESTLPHLQTLIAHAADQITILPGGGITSQNAAAIADKLGVKELHGTKLIQF

SEQ ID NO: 6731 - protein, 272 aa, Lactobacillus casei
MFDIIKAVIIGIVEGLTEFLPISSTGHIDLVDQVVKLSQGREFMNMFEYVIQFGAILAVILLYFNKLNPFSKPTVKEQNATWQLWAKVIIAVLPSVVVGLPLNDWMDKHLHTPLVVATTLIVYGVLFIIVENYLKNKPSHITTLADITYQTALLIGLFQVLSIVPGTSRSGATILGALLIGTSRYVATEFSFFLAIPTMVGVSILKIGKYLLQGNGFTGEQWMVLLTGSVVSFLVAIVAIKWLLKFVQTHDFKPFGWYRIALGAIVLLVMFL

SEQ ID NO: 6732 - protein, 346 aa, Lactobacillus casei
MKQRLLLGGYTRHGGAGIYAGTFDDTQGQLAAPTPLISDLGSPTYLAVSDDNILYAIDAEGDEGGVASYDLNTNPPRLINRVLAPGSSPAHVSIDENRQLVYASNYHEGRINVYKINRDHSLTATDEVVHSGNGPRPEQDSAHVHFAAVTPDFQRLAVVDLGNDTLTTYAVSDAGKLSDPVVFHTEPGFGPRHIAFNHNQPIAYLLGELSSKVSVLSYDAATGSFELITTLPTIPTDYTDHNGAAAIRLSSDQRFLYVSNRGFNSLTVFAVSPDGRNLTQLQQISTAGDFPRDFNFDLTEHYILAVNQNTSNGTLYSRDPKTGTLTEQQRDIPTPEAVNVLFLADK

SEQ ID NO: 6733 - protein, 127 aa, Lactobacillus casei
MQFKATVTAIGKDALSSKDPMIILFGPQATDALRDVAVIQQFADPTSLAQFSIQAGDRITIDETTFTMTYVGQLAISNLKAIGHVTLLFQDVPADKPMQNAIYLKPTHRPIFKVGTTLLYETQNELK

SEQ ID NO: 6734 - protein, 89 aa, Lactobacillus casei; identical to SEQ ID NO: 760

SEQ ID NO: 6735 - protein, 329 aa, Lactobacillus casei
MNNGMQIFDYEDIQMIPNKCVVRSRKEVDTSVKFGPHTFKIPVVPANMQTIIDEPLAIWLAEHDYFYIMHRFQPERRMDFVRDMKKRGLIASISVGVKDEEFDFIEALAANELSPDYITIDIAHGHAQIVIDMIQHIKHYLPNAFVIAGNVGTPEAVRELENAGADATKVGIGPGKVCITKLKTGFGTGGWQLAAVRWCAKAARKPIIADGGIRNNGDIAKSIRFGATMCMIGSLFAGHEETPGKHVTIDGKEYQEYYGSASEYQKGTHHNVEGKKILLPVKGKIGDTLKEMQEDLQSAVSYAGGRDLEALTKVDYVIVKNSIFNGDQY

SEQ ID NO: 6736 - protein, 315 aa, Lactobacillus casei
MLSIYRFDEKSGQLNPQSRIRPGVWINAVNPTPEERQQLQDKANLSEAFLLYGLDPDEGARYEFDEDNDSHLFIFDMPTVTRDARKKVVYKTGPLAIIITNIAVITINEEPIPLLSLFSEGKISNFNPEHQSRSVIQILYQISISYLTYLRDLNKAREAIESKLQHNLRNEELYGLMGIQRSLVYFMMSLRTDRNVLEQLKRTNPLNLNEDDQDSLEDTLIENQQAVEMAQISNSIINETADTYSSIINNNMNGVMKFLTSYSILLTIPTLVFSFYGMNVHLPLADMKVSWIITIAISIALAVVLAFQFWRNKYF

SEQ ID NO: 6737 - protein, 280 aa, Lactobacillus casei
MRKREAKIQLAAQQEPLFACPVCGNAMRIEKDSLVCSQGHVRDFSRKGTVNFLSQQVATEYTATMLAARRRMLAAGLFRPFLDAMAAHLQPHQRLLDVGCGEGTPTAYLAEQKQQVAVGFDISAPAINLAGSLATPALFAVADLAHLPFVDAAFDTVTDIFSPGNYQEFRRVLRPNGQLLKIIPRAGYLKELRTGLYAGTAKATYDNRPVLDRFLATFPQAKIHPITYDFPLAADQFADLLTMTPLSWQAPAERRRAMLANPLSSIHIEVDLLIVAHLVK

SEQ ID NO: 6738 - protein, 169 aa, Lactobacillus casei
MANHIVLFEPLIPANTGNIARTCAATNSYLHLIKPLGFETDDKHLRRAGLDYWAKVRIIYHDSLDDFMDTVADPQHLYLITKFADQTYSDRDYTDTDVDHYFLFGKETTGLPEGFMRQHADQCLRIPMTENVRALNLSNCAALVVYEALRQQQFAGLETVHTYQHDKLK

SEQ ID NO: 6739 - protein, 135 aa, Lactobacillus casei
MEAKRYPITVESFHYDLVKSDTPAKNDLQVAMRQIQWSDPKRQEELKKGNLFEMMIPFDVVPDNSGFEISGKITQIVQVMDYFGEANELPQEELGKLSRPLVETIETLTYQVTAVALDQGVNLQFGASDEQPGQH

SEQ ID NO: 6740 - protein, 774 aa, Lactobacillus casei
IIIEMAQKRGGRRSPRKKRPTKQQQHTLSWVGALFVVFSSLAFFRLGMVGTVLANVFRLVVGDSFLVVSAATIVTGIWFLLADRLPKLARHVWVGLAIVLIAALVLLTSITMATLNVHSHYLLTTWRLLQNDFGLMTTASQVGGGLLGASLFSLLAPLLSSLGATILAWFGVVAGVLVFLGVGANQVFNWLQALGQACKRGVLQIHSSFVDLKKEHAKKAAARPTTSAVKPKPAAVSTDTQADPASERADDFTINGPAPVPPAPQSETPARVTPPSSTAAHVSATSPKPAAVHDPEMPAADYQLPSLNMLTATPPVDQSAEYQAIKTNRTKLKDTFESFGVKVAVKSATLGPSITQYEIQPAVGVKVSKIVNLSDDLALALAAKDIRIEAPIPGKSLIGIEVPNQHIATVGFKEVMAETPKAPNHPLVLPLGRDVNGKVVTFDLTKMPHLLIAGATGSGKSVMINVILTSILMRAKPTDVRLMLIDPKRVELSVYNGVPHLLTPVVTEAKKAPSALNKILTAMDERYQRFAAAGVRNMKEFNQKVAADPASGQTKMPYIVVIIDELSDLMMVAGHEIETAIVRLAQMARAAGIHVIIATQRPSVDVITGLMKANIPSRIAFATSSGIDSRTILDSNGAEKLLGRGDMLFSPIGASKPLRIQGAFIPSIDVERVVKAITDQVSPAYVESMTPTESVETEQQGDSEDELYDDAKAFVIAQQSASTSMLQRRFRIGYNRAARLIDDLEANQIVGPSEGSKPRKVFATPESATNANQS

SEQ ID NO: 6741 - protein, 420 aa, Lactobacillus casei
MQKEIKPGVWLIVLPTTQFKTTRINVQFLTPLRRATITKRTLLTSLLETNSKQYPTQAAMAAHLEALYGANFSIGVAREGRLHRIGVTMSTVDDRFTDQPLLPQAVAFLRSVLFAPNFHNDQFDQVTFDREKENLDHYLASLDDDRQTQAVLGVQRLYFGVDPDQAIPSFGTREDLAPLTAADLTDYYHQLMSQDQVIITVLGDVQEQQVEKLFADWPLAARARTMPAIAFDLPPHPEVLTQTKTVVAQQAKFDLAYHITTDLMGPKYTAALVAEELFGGSSLSLLFTNVREKASLAYYASSMLDAFRGLMLVQTGIEGKAHDQVADLIQQQLAAVVNGDFSDKLLQSVKDGILDHQRAAYDSPRFLTNQALYQLLVPYAPQDFESFARRIQAVDRQAVQEAAAGMQLQATYFLTGEDSE

SEQ ID NO: 6742 - protein, 431 aa, Lactobacillus casei
MKTQYFSDVDETLVTTTLPNGLRLQVVPRPAYHKSYAIMTTDYGAIDTRFAPDGKKMVTYPAGIAHFLEHKLFEKEDHDAFDLFGETGASANAFTSATKTSFLFSATTQLTKNLQILLDFVQEPFFSESSVAKEQGIIGSEIQMYQDDPGWRVYAGLLENLFPNHPAHVDVAGTADSIAQITPEMLYTIHRIFYQPSNMTLVIVGNIDATEIIDFVADNQAKKHFPAPQPIVRGVEADLQTADIIPYRELKMPVSRPKTLVGFKGQVAIPQTTEGWRYQLTIRLLLEVLFGDSSQLYQEWYDQGLIDDSFDFDFTNQRSFSYGLVGGDTDDPQALSAAIKQVLLHATAQSDLTSERVELIKRASLGKYYAGLNGLNGVANQLSALSFGQARLFDFPQILNSISFDDVKDLIPQIFQSDALTVLTMLPEGQS

SEQ ID NO: 6743 - protein, 242 aa, Lactobacillus casei
MRSALIIGASGDIGQAVAAKMAADGWSLYLHYYRHEKIVTDQVKTFQAAYPQQDFIPLQYDLTDDQHLDKLTAQLFSLDAVVFAAGMTYYHLFKETTVPEMTALMRVHLLTPMVLLTKVEHKLAQSGHGRVIFIGSVYGGTGSAMEVAYSTVKGAQSAFVKAYAQEVASLGITVNVVAPGAVSTKMNTQMFDQSSLAKVRAEIPAARFATPQDISYYVTMLTAEDAAYLTGQTLYVTGGWRI

SEQ ID NO: 6744 - protein, 312 aa, Lactobacillus casei
MDEIGQKLRDARIEKGYTIDDLQQITKIQKRYLIAIEEGHFDALPGDFYVRAFIKQYADTVGLDGDELLTQFQQDIPEPQPKEYAAQSVENKTRATRAEEASPVNRLRRYLPQIAVAGIVVVAVIVIYAVMLMSQSGPKQTIPADSESVAVSSKRSSAKSSKSSKSSKASSKSSKASASSSSKPSEKASKQKKEKSGKLDISVAAANGATQAVTLKNLPTTGNKLTLGAKGATAWVSVIVNGTTTWQGSLTSGNTQEVSLPDNASTFQVRSGNATATTIKLNGKDVDISNGTSIVRTITFTNSTSESEGSQE

SEQ ID NO: 6745 - protein, 197 aa, Lactobacillus casei
MNLPNKLTLIRIFLIPVFTLLLAFNWPAGYLTIAGTKVAVSWFIALIIFIIASLTDFADGHIARSQHLITNFGKFADPLADKLLVMTAFIFLTAAGQIPAWGTAIILWRELAVTGLRLLLSNKGEVLAAAWPGKIKTNTQMFAIIFLMLNNAWFNNINVPFALILFYVAVFFTIYSGVEYFYKNRAVFADSFGSSHE

SEQ ID NO: 6746 - protein, 413 aa, Lactobacillus casei
MQAEIIAVGTEILMGQITNTNGAYMAKQLAALGIASYHQQVVGDNAQRLADAISLAEKRSDIVILIGGLGPTPDDLTKQTLAAHLNLPLVEDADAMAKLAARVKQQQRPMTPNNKLQAMYPQGADILVNRIGLAVGAWVEQHQHAYVLLPGPPKEFIPMVDHELLPHLAKYSGHHEAFVSRVMRFFGVGESQLVTDLGDLIAKQTNPTLATYIKDHEVTIRVTASGETQTDAEAKLEPVIRAIMDREGRYFYGYGDDNSLAKELVKALAATDKQITAAESLTAGAFQAALGDVPGVSNYFKGGFVTYALATKAAFLNIDARELAAHGVVSEFTAKAMAEHARQRAAADIAVSFTGVAGPDTLEGQPAGTVWIGLARMGQAPVAQVYHFPGGRNDVRKRAVMTGMMIALKSLRD

SEQ ID NO: 6747 - protein, 347 aa, Lactobacillus casei
VADTERQEALATALKKIEKNFGKGAIMKMGDKADTRVSAISSGSLAIDEVLGVGGLPRGRIVEMYGPESSGKTTVALHAVAMVQQHGGTAAYIDAENAMDPKYATALGVNIDELLLSQPDTGEQGLEIADELVASGAIDILVIDSVAALVPQAEIDGDMGDAHVGLQARLMSQALRKLSGNISKTKTIAVFINQIREKVGIVFGNPEITPGGRALKFYATVRLEIRRSEQIKNGAEIIGNRTKIKVVKNKVAPPFKVAIVDIMYGRGISQSGELVDMAVEKDIVEKSGSWYAYQGERIGQGREHAKAYLETHEEMRKKIEGQVREAYGMPLNQVIEVEDPDVSARAS

SEQ ID NO: 6748 - protein, 523 aa, Lactobacillus casei
MSSVTLVSITLAAVIALAVGLLIGFALQKKLHQNSLDRATQTAEGIIEAAKKEAATLKKEKLLEAKDENHRYRTQLEDELKDRRAEVQKSEHRLNQREDTLDRRDDTLDRKEQSLADREANLNKRQQQLDEREQDISSEISKQQTELERIAELTHEQARTQILDETQSELTHERAVMIKESEDEAKEAADKKAKVLIADAIQRSASDIVAETTVTVVNLPNDDMKGRIIGREGRNIRTLETLTGIDLIIDDTPQAVVLSGFDPIRREIARIALEKLIQDGRIHPARIEEMVDKARKEMDDRIREIGEQAIFDVGIHNMHPDLIKILGRLHFRTSYGQNVLDHSIQVAKLAGVMAAELGEDVTLAKRAGLLHDIGKALDHEVDGSHVEIGVELATKYKEPKTVINAIASHHGDVEPTSVISVLVAAADAISAARPGARSESLENYLHRLEKLEAIANSHAGVDHSFAIQAGREVRVIVQPEKLSDDQSVILARDIRNEIEKELEYPGHIKVTVIRETRTVEYAK

SEQ ID NO: 6749 - protein, 239 aa, Lactobacillus casei
IMPACTFAMILYMEMBERYIGZMTKPYLTIKETGNYTRIIKKSRFITHLARIQSEDEAKTIIDQISHENAKANHNVYAYVLGNESQIQRASDNGEPSGTAGSPTLEGLLNHDIRDVVAVTTRYFGGIKLGAGGLIRAYAGNVNNAIETIGIVARIKQKTVTFQIPYADLEPLQHFLTTHHLTIAKIDYGVKVTMTLYLDEDQLEASLALINDFLNGQFSPTIGQSEYREAPYPFAQNRE

SEQ ID NO: 6750 - protein, 420 aa, Lactobacillus casei
MDLAGAQLTQAELARLAVSNIAQATVVPALVKDKGHWCCQRCRSQLPVALPDGRFYCPECVTLGRLTDRDSLYRFDQPHQPVGDGRLTWHGTLTPDQQAASDALMASVTAGRDHLIWAVTGAGKTEMLFPTVARLIQQQQRVAIVSPRIDVIRELAPRFRAAFATTPITVRYGGHFDQTDSDLLLATVHQLLRFYQAFDLIVVDEVDAFPMNGTPMLHQAVQQARRGSVAYLTATPDRVLKKALHNGLGVSRLFRRFHGHPLPVPTIRLMNLQKVPRQLPTAMITWIRQVLATDRICLLFVPKISWAEQVADVLRQLGLKTAGVASTDPQRAEKVMAFRQRQLDVLVTTTILERGVTVTQCAVGVIAAADREFSAAALIQIAGRAGRAADSPDDPVVFFTDRYTLALLAAKRQIVMMNGR

SEQ ID NO: 6751 - protein, 172 aa, Lactobacillus casei
MQPTEQLCSDCRKWERQGTLLHNRALFAYDASMKAWIYQYKGLGDYRLHVAFQDLIAARLRHATALVPIPSEPKHFELRGFDPILGLFGCLRLRPWLRKTATERPQAQKTRQERLKTPQSFHVLVPEQTLNRVRQITLLDDLYTTGRTLYHARDALVAAGFKGTIDALTLIR

SEQ ID NO: 6752 - protein, 185 aa, Lactobacillus casei
MLTYNVRGENIEVTEAIRNYVEKRISKLNKFFGGSVTATAHVNLKVYPDKTAKVEVTIPLSFLTLRAEETSPDLYASIDLVTDKLERQVRKFKTKINRKSREKGFGQIDVDTSAPAEPKPAEDDDNLTVVRTKRVSLKPMDSQEAILQMDMLGHNFFVFEDADTNGTSIVYKRRDGRYGLIETNE

SEQ ID NO: 6753 - protein, 787 aa, Lactobacillus casei
MANILRKWVESDKREIGRLGKIADQVQRYEDEYAALSDEQLKANTQKFKDRLAAGETLDDILPEAFATAREGAKRVLGLFPFRVQIIGGIVLHEGNIAEMKTGEGKTLTATMPVYLNALTGKGVHVVTVNEYLSTRDATEMGELYNWLGLSVGLNLNSKNSDEKREAYNCDITYSTNSELGFDYLRDNMVVYKEQMVQRPLNFAIVDEVDSILIDEARTPLIISGGAEKTTGLYIRADRFVKTLKADTDYKIDWPTKTISLTESGIRKAEKNFGLDNLYDTENTALTHHIDQALRANYIMLKDIDYMVSNGEVLIVDQFTGRAMEGRRYSDGLHQAIEAKEGVQIQDENKTMANITYQNFFRMYNKLAGMTGTAKTEQEEFREIYNMEVISVPTNKPVIRVDSPDVLYPTLDAKFNAVVEDIKERHKKGQPILVGTVAIESSERLSKQLDEAKIPHTVLNAKNHFKEAEIIMNAGQRGAVTIATNMAGRGTDIKLGPGVTKLGGLAVIGTERHESRRIDNQLRGRSGRQGDPGSTQFYLSLEDDLMKRFGSERIKAMLDRFKVADDDQVIQSRMISRQVESAQKRVEGNNYDTRKNTLQYDDVMREQREVIYKQRQQIIDENETLKPVLMAMINRTITRIVQTHTQGEQKDWNLDALYAWITANMVDPEKFKRSELDGKSQDELIGLLADLAETNFKQKNKQLGDDAQMLEFEKVVILRVVDSAWTDHIDAMDQLRQSIGLRGYGQMNPLVEYQEEGYRMFEEMIASIDDDVTRLFMKAEIRQNIRR

SEQ ID NO: 6754 - protein, 332 aa, Lactobacillus casei
MAEPGFWDDSEAAQKVIDANNALKEKHDRFYALENELEDLEAGLELLQDEPDPDLQHEEETKIKDLQDKLDQYEMQLLLNGPYDHNNAILEIHPGAGGTESQDWGSMLMRMYQRWADQNGFKVEVADYQPGDEAGIKSVTLLINGENAYGLLKSEKGVHRLVRISPFDSAGRRHTSFASVDVMPELDNSIQVDIRPEDVKMEVFRSSGAGGQHINKTSSAVRLIHIPTGIVTSSQAQRSQFQNKATAMAMLKAKLYQREEEAKRAKAKAIQGEQKDVAFGSQIRSYVFHPYTMVKDHRTNYETGNGNAVMDGDLNPFINAYLQWELSQKNPD

SEQ ID NO: 6755 - protein, 228 aa, Lactobacillus casei
MIQMENVTKQYANGVTAIKDVNLKIQDGEFVYVIGPSGAGKSTLVKMLYHELMPTSGTIKIDNFDFSTMKPSEVPFLRRHIGIVFQDFKLLPRLTVYENVAYAMQVIEAPDDEIKDRVLEVLGLVGLEQKLRRFPDELSGGEQQRVSVARAIVNKPKVLIADEPTGNLDPQTSDEIVDILERINANGTTVIMATHNKDIVNERQHRLLEIAGGRLVRDEEGGTYGNEE

SEQ ID NO: 6756 - protein, 295 aa, Lactobacillus casei
MKSKVFFRHVKDSLRSLRRNGWMSVAAVSAVTVTLLLVGIFMALIFNLHHISQQVENDVQVRVYIDKKTTVKQRDELKNKLKKLDHVNKVTYRSRQQELDTIIGGYGSQWRMFSGDQNPLSDVYMVKTTSPKATIIVSKEAQKLDHVVDASYGGRTAKKLFNSVDLAQKWGLGFTILLLFVAVFLINNTIRITILSRSDEIRIMRLVGATNSYIRWPFLLEGAWTGLFGAILPIVVVDVGYAVVYHSFSMANGASGYSLYANMPFLFWLDLMLAGIGIVIGALGSVISMRRFLKF

SEQ ID NO: 6757 - protein, 369 aa, Lactobacillus casei
MAVIIALLISPVGLAFWLALGLTILFAVRRTSRERHQYLRAIHPKHIEIARFFWVGILIGIVVSAISVLARLQVSLAALLALSGLTVIGLILSAWSFSPWWLGLASLATFIQPDYSDTDGQLAANLALLIGLLWLTQAVLARLNRGDQLESPVILVDRRQRKSATFRLRQFYWVPLLVPVDPAQVAGSPVLTVIIQAFAIVGLPLILGASFTAQHDRAKMHWQRSWPWFAGAGGALVVYGVAARLLFLPALVSAIVPACISVILGIGLLWQGHKVYLTVTRTDRGVVLIGVVPDTPAAQMNLQPGDRVLSCNHIAVNSASELYDAIQKEPTYCRLRLQQADGELRLAETAIFSGAPHELGMILFPEETA

SEQ ID NO: 6758 - protein, 235 aa, Lactobacillus casei
MKKILIVDDEPAILTLLQYNLETEHYQVETATDGQEALDKVRSEPFDFIILDLMLPSLSGLDVTRKIREDKIQTPIMILTAKDNETDKIVGLELGADDYVTKPFSPREIIARIKAIERRSQSQPQTTARSGNDNQITVGQITIDPENYKASKAGHRLQLTPKEFELLVYFAQRVGKTLSRDALLNGVWGFDYPAETRMVDIQVSHLRDKIETDPKHPDYLKTVRGFGYQMEAPHE

SEQ ID NO: 6759 - protein, 555 aa, Lactobacillus casei
MNKRVFRRALVISLLSLAGFFVLVTTVNQQIVHQQARDLRRVARTYVTSDHDGVDRQALAESEAAFITIIPDNPQTTRQKVMADALRGRRAKAFVTSVNVYGRTEQAYLFRDHGQWVAVSRYKSSVWTTAPEQFWILTLIFAALIALILLWLFRSEHQYQEAIRGMSHNLDRIREKKEPDPVILPPKSPFVPVAQRINALAAEQAHLREKVAVRQSSFDRLIDNLPLGVMLIDTNKDVILHNHAMSQLLGHQIPQPRHSYLDDVKTYALARMIEHTFRHEKTHHQELTVLATQKSVDASVIPLNQGISRLQVLVILYDVTYLRQVEKMQLDFVGNVSHELKTPVTAIAGFAETLLNGAKNDPATLDKFLGIIFDESKRLTQLINDILTLSRPETNQAVQATVALKKLVDDALHNLDKVIKDKQIRVEVAIAPDLQIVTDERKLTQIVRNLLNNAVFYNRLAGHVTITAQVVGDHLSLAVADTGIGIPEEEQARIFERFYRVDKARSRHNGGTGLGLAIVAELVKSMDGRVAVNSQVGVGSTFTVTLPVGQNNRPT

SEQ ID NO: 6760 - protein, 288 aa, Lactobacillus casei
VKKIVTLFTIMLLAFTASACGSSSNSKQSGESITAVGSSALQPLVEAAGEQYQTEHLGVFINVQGGGSGTGLSQIQQGAVDIGNSDLFAEEKPGINAKKLVDHKVAVVGIAPIVNPDVGVKNVTMAQLQQIFLGQITNWKQLGGKNVPIVLVNRAQGSGTRATFEKWVLQGKQPVAAQEQDSTGMVRQIVGSTPGAISYVAFSYIDKTVQSLSVDGVAPTDTNVTTNRWRIWSYEHMYTKGQPRGLTKQFLAYIMSSPIQKKLVQKMGYIPMTQMKVVRDASGHVSKQ

SEQ ID NO: 6761 - protein, 307 aa, Lactobacillus casei
MDPIREAMLKKSRSAKLERRGKMISLFCITLIVIVVVAIFFFVASKGLATFFQNKINPWSFLTKSVWNPSIKDAHGNPEVGALPMIVGSFGVTFLSAIIATPFAVGAGIFMTEISRKWGQKILQPVIELLVGIPSVVYGFIGLSVIVPFIRHIFGGTGFGILAGTFVLFVMILPTVTSMTVDALKAVPRHYREASLALGATRWQTTYRVVLRAAIPGILTGIVFGMARAFGEALAVQMVIGNAALLPKNLVSPASTLTSVLTSGIGNTVMGSLDNNALWSLALLLLLMSLAFNLLIRWIGKKGELNK

SEQ ID NO: 6762 - protein, 294 aa, Lactobacillus casei
MNPKIADKVATTVLYIISGIIIIILASLLGYILFQGVPHISWHFLTSPAQSFEAGGGIGIQLFNSFYLLLLAMLISTPISLGAGIYLSEYAKKNWLTDVIRTSIEILSSLPSVVVGLFGFLIFVLQFKFGFSILSGALALTVFNLPLLTRNVEDSLRGVGNEQREAGLALGLSRWETVLHVVMPEALPGIITGMILGAGRVFGEAAALIYTAGQSAPALDFTNWNPANIASPLNPFRPAETLAVHIWKINSEGIQPDAVAVSAGASAVLVIAVLIFNVGARYFGNRLFKKMTAA

SEQ ID NO: 6763 - protein, 272 aa, Lactobacillus casei
MQELEKYSLDDTYIRPFDRDKQEIAIETKDLHVFYGDSEAIHGVSLPFERYKITALIGSSGSGKSTYLRSLNRMNDNIESARVTGKIMYRNIDINSDAVDVYEMRKHIGMVFQRPNPFAKSIYDNIAFALRRFGLKDKKKLDEIVETSLKQAALWDQVKDDLNQSGMSLSGGQAQRLCIARAIAMKPDILLLDEPASALDPISTSAVEDTLLALKDKYTIIIVTHNMQQAARISDYTAFFYSGAALEYDETRKIFTRPKIKATNDYVSGHFG

SEQ ID NO: 6764 - protein, 254 aa, Lactobacillus casei
MAEAQKIITSSDVHLFYGKFEALKGISLDFNQHEITALIGPSGCGKSTYLRTLNRMNDLIPGVTITGTISLRGQNIYAPSEDVVQLRKQVGMVFQQPNPFPFSIYENVIYGLRLAGVKDKSKLDEAVETSLKQAAIWDEVKDHLHDSALSLSGGQQQRVCIARVLAVKPDVILLDEPTSALDPISSTQIENMLLGLRDQYTIILVTHSMHQASRISDKTAFFLTGNLIEFADTKQMFLNPKEKETEDYITGRFG

SEQ ID NO: 6765 - protein, 225 aa, Lactobacillus casei
MRRLFVDELNDLHVRFSEMGMMVNEAIYKSVKAFINHDKSLAREVIQEDKHINEREVDLEKRSFELIALQQPVTTDLRVIVTVMKASSDLERMGDHAVSIAKSTIRVKGKTRVPQIETEIAGMAEAVKEMVEQVLDAYVKEDSARARKIALEDHGINDFSSRIYKECIRQMQDNPETVVGSMDYMLVSSYLERIGDYVTNICEWIVYLKTGKITELNSNAIEDKF

SEQ ID NO: 6766 - protein, 496 aa, Lactobacillus casei
MNERERILDLVKKGVISSEEALVLLENLAKQQGSQADSPADHTAPEDDSESDTHDQAKHDDHEETDTDTDAALTELNTEIAEAAGALDAATTQVTSINKQIEANNEQIIVLDTMEDLEALSPEKYQKRGELKQENQKLTDQLAELNGQVESLKANLATLRHQKHDLERQKIGDKIFNDEWQKDARDVFSELGKNIGDATSQIGGFVKDTVNNVLDNVDWKNVTVTVPGLATEKFEHVFKFPDSKATILDVKVANGDVHFKPWDQPGIQVEAAIKLYGKMDAPTPLDAFNDRSRIDVTDDHFSFQVPNKRVQADLVISLPKRSYDHVAVRLLNGSADLTGMTGKDFYVKSTNGQMTFTNIDGVMIESEGVNGSIKVQGGHTHDLLLTTVNGDVSVDADPATAALKTVNGTVRATYQTDFTKLEGTSMNGNVKVAVPASIALNGEARTHFGSIKSRLSNVTEPAKGIKRFELERPGTGSSELKLNTTSGNIQLKDSND

SEQ ID NO: 6767 - protein, 86 aa, Lactobacillus casei
MPFLLIPLMFFIVGLVLVAVFAIGIILLKMLIVPALLVVLAVWLFSRHDRDGRRGPRHPYRDQGTSRPRKNATHVTESHDDDWSDF

SEQ ID NO: 6768 - protein, 111 aa, Lactobacillus casei
MNFIKRTIITTAVFLIYAQLFPSQLYVAGFGVAVVGALVLGVLNGLLRPILVILSIPITILTLGLFLIVLNGLMLSMMTWFVSGIVFSSFGSTMMLAIIISVMNMIFVGKK

SEQ ID NO: 6769 - protein, 319 aa, Lactobacillus casei
MADSVTVRQLVKATKLEVYSGEEYLDSRQVVLSDISRPGLELTGYFNYYPHERIQLFGRTEISFARNMSSEERLLILKRMATEDTPAFLVSRGLQPPAEMITAATAAHIPVLGSRLPTTRLSSLITEYLDGQLAERRSMHGVLVDIYGLGVLITGDSGVGKSETALELVQRGHRLIADDRVDVYQQDEQTIVGAAPPILSHLLEIRGLGIIDVMNLFGAGAVREDTTISLIVHLENWTPDKTFDRLGSGEQTQLIFDVPVPKITVPVKVGRNLAIIIEVAAMNFRAKSMGYDATKTFEKNLNHLIEHNEASDQSSSEEK

SEQ ID NO: 6770 - protein, 275 aa, Lactobacillus casei
LLLVLNPIAFQLGGLEVHWYGIIIASAVLLAVYLAMKEAPKRGIKEDHILNLILWALPFALIGARLYYVAFEWPYYAAHPGEIIAIWHGGIAIYGALIASVIVFAIYCRIEWLPAWLVLDIAAPTVMLAQAIGRWGNFMNQEAHGAITSLAYLRGLHLPEFIIQQMNIGGAYRQPTFLYESMWNLVGFALIMTVRHHQHWFKQGEIVLSYVMWYSFGRFFVEGMRTDSLYVVPGLRVSQILSIILFIVAGALIWYRRRRGDVAWYLDGNPLKAVE

SEQ ID NO: 6771 - protein, 351 aa, Lactobacillus casei
VPTKIAVLGAGSWGTVLANLLTENGHDVYLWSHSPEQVATMKQTHKNEHYLGAEFTLHDALHVTADLGQALDQATVILFVVPTNAIRSVAEQVKPILQAHRGRGERPIIVHAAKGLERGSELRISQVLAEVLPPDLIQGIVVISGPSHAEDVATHDITTLTAASEDLPLAKKVQQLFMNDYFRLYTNTDVIGVEIGAALKNVIAIGAGALHGLGYGDNTKAALMTRGLAEISRVGVKLGAEPLTFIGLSGVGDLIVTCTSVHSRNWRAGNALGQGEKLSDVLKNMGMVVEGVSTTKVAHHMARELGVDMPITDAIYQVLYENAPIRAVITDLMQRSGKPEFDFDNASLQKH

SEQ ID NO: 6772 - protein, 315 aa, Lactobacillus casei
MAKKYDVIVIGAGPGGMTAALYASRANLSVLMLDRGVYGGQMNNTAEVENYPGYKSILGPDLGQKMYDGATQFGAEYAYGNVISVQNHGATKLVKTDEDEFEAKAIVIATGAEHKKLGVPGEEAYSGRGVSYCAVCDGAFFKDRELAVIGGGDSAIEEGLYLTQMAKKVTVIHRRDQLRAQQIIQKRAFANDKMHFVWNAQVQEIQGDDMKVTGVKYRDKETGEEHVLPVAGVFIYVGIMPMTEPFQDLGILDDHGWIPTDDHMRTKVPGIFAIGDVRAKDLRQITTAVGEGGTAGQGVFNYIQSLNDTNIEVKA

SEQ ID NO: 6773 - protein, 575 aa, Lactobacillus casei
VSYRDTYQQWVDEPTLDPELKADLKKMADDETTKEEAFAAPMAFGTAGMRGVLGAGIGRMNIYTVRQATEGLARFMDTLTDETKARGVAISYDSRYMSQEFAYQSAGVLGAHGIKSYVFDQLRPTPELSFAVRHLKTYAGIMITASHNPKQYNGYKIYGPDGGQMPPEESDKITKYARSASDLFAIKALNVHELRAKNLMQPIGEDVDEAYYAEVATVTINPDLVHTVGKNMSLVYSPLHGTGRIPAQMVLRNAGFENFRLVPEQSIADPEFATTPFPNPEFAQVFDLPIALGKKIGADVLIATDPDADRLGTAVKVGDHYQLLTGNQIASVLLHYILEARKQAGTLPKNGAVVKSIVSTELATAIAKDYGVDMINVLTGFKFIGDQIKHFQATGEHEFLFGFEESYGYLIKPFVRDKDAIQSTVLLAEVAAYYQSQGKTLWDGVQELYKKYGYYAEKTVGVDFEGVDGPKQMANLMTKFREEQPDDFAGVKIAKVEDFLSQEAKLADGTVEKLTMPSSNVLKYILEDGTWIAIRPSGTEPKVKFYVGTKAETDAKAQEKLEAFEKALNDFREEA

SEQ ID NO: 6774 - protein, 215 aa, Lactobacillus casei
MGMHQFIQGLSNLETLRRAPGFFKYQEHSVAAHSFKVAEIAQMLGDVEELAGNKVNWQMLYEKSLNHDYTERFIGDIKTPVKYATPTLRQMLADVEATMTENFIKNEIPRDFQDRYRRRLSEGKDDTLEGQILSVADKIDLLYEGFGEIEKGNPEQVFLDIYTESLSTILEFKNRPSVRYFLDQVLPDMLEEKFASRDQLAKLTKATMAEHEPSK

SEQ ID NO: 6775 - protein, 671 aa, Lactobacillus casei
MIERIADRKFDLVSPYQPAGDQPQAIAKLTKGFEEGKKEQILLGATGTGKTFTMSNIIANLNKPTLILSHNKTLAGQLYGEFKEFFPHNAVEYFVSYYDYYQPEAYVPSTDTYIEKDSAINDEIDKLRHSATSALLERNDVIVVASVSSIFGLGDPHEYKNHVLSLRTGMTIDRNTLLRQLVDIQFDRNDIDFQRGRFRVRGDVVEIFPASRDDHAIRVEFFGDEIDRITEVDALTGEVIGTRDHVAIFPATHFMTSDEQMQRAIKSISAELEDRLKVLRGENKLLEAQRLEQRTNYDIEMMREMGFTSGIENYSRHMDGRKPGEPPYTLLDFFPKDFTIMVDESHVTMPQVKGMYNGDRARKQMLIDYGFRLPSALDNRPLKIDEFEKHVKRILYVSATPGPYELSRVPKEDIAEQIIRPTGLLDPKIEVRPVMGQIDDLVGEINKRIDAHERVFITTLTKKMAEDLTDYLKDMGIKVRYLHSDIKTLERTKIIRDLRLGKFDVLIGINLLREGIDVPEVSLIAILDADKEGFLRAERSLIQTIGRASRNEHGKVIMYADKVTDSMKAAIDETKRRRAIQEKFNEEHHIQPKTIIKPIRAAISTYEQSDDEKAEAKKTFAEVDYEDMTKADKKELVANLRSQMQAAAKKLDFEQAASLRDTILELQADMS

SEQ ID NO: 6776 - protein, 962 aa, Lactobacillus casei
MANDKIVIHGARAHNLKNIDVTIPRNKLVVMTGLSGSGKSSLAFDTLYAEGQRRYVESLSAYARQFLGQMEKPDVDSIDGLSPAISIDQKTTSKNPRSTVGTVTEINDYLRLLWARVGHPICPNDGTPITSQSVEQMVDRVLALPEKSRIQILSPIVRRKKGSHKKVFAKIMREGYVRMRVDGEVMDATADYELDKNKAHDIDIVIDRIVVKPEARSRLFDSFEAALRLSEGYANVDVIGGETLRFSEHFACPICGFTISEMEPRLFSFNAPFGACPECDGLGVKLTVDMDLVVPDPSMTLAQGAIAPWNPISSQYYPELLEQAATAFKVRMDVPFEKLTKRERTVVLDGSNGKPFHFHYENDFGGVRDVDVPFEGVLTNISRRYAETNSDFTRQQMRSYMTALPCPVCHGKRLNRQALAVKISGRDIAEVSDLAIKDALPFFKQIHLSEAESVIAQPIVKEVVDRLTFLVNVGLGYLTLSRSAGTLSGGEAQRIRLATQIGSNLSGVMYVLDEPSIGLHQRDNDRLIASLKKMRDLGNTLIVVEHDEDTMRAADYLIDVGPGAGDHGGRIMAAGTPKQVARVRKSITGQYLSGRKFIPVPLKRRTGNGKVIRLEGAADHNLKHINVDFPLGKFIVVTGVSGSGKSTLVNSILRRALAQKLNHNSEKPGPYDKILGYKNIEKLINIDQSPIGRTPRSNPATYTSVFDDIRGLFAETNEAKLRGYKKGRFSFNIKGGRCENCKGDGIIKIEMNFLPDVYVPCEVCHGKRYNSETLEVTYKGKNIAEVLDMTVEEATNFFKNIPKIRRKLQTIVDVGLGYVKLGQSATTLSGGEAQRMKLASELQKLSTGKNFYILDEPTTGLHTDDIKRLLEVLERLVDEGNTVLVIEHNLDVVKSADWVIDLGPEGGDGGGRVIATGTPEQVAEVADSYTGQYLKPVLIRDTKRTKEAAAGKNGQAKSSTKK

SEQ ID NO: 6777 - protein, 179 aa, Lactobacillus casei
MLNRKSFGFDWGQFITGILFLVAAFVVLRYPLATLRTVTFIFAVVAIIRGIAVLAGFSTLRQFTGRLAWISLIMGIFDLVIGLIFLLNSGLGVATITMMFAIWFLVDSVGSLFNVGHLRVAGTGWFVVYLILDILAVIVSLMLFMQPVIAAVTLVTLLAMFFVLFGIECIVIAFARRNI

SEQ ID NO: 6778 - protein, 295 aa, Lactobacillus casei
MTESLDLVIITGMSGAGKTVAMQAFEDLGYFCVDNMPPALLPKFWELVKESGKISKVALVVDLRSRAFYDQIIDMLANLDNNAYVHSRILFLDATDEELVSRYKETRRSHPLAMEGRLMDGIKKERVLLTELRNRAQVVIDTTTLSPRQLREKIFLNFKENSGQPAFHIEVMSFGFKYGLPIDADIVMDVRFLPNPFYVKAYRPKTGLDQEVYDYVMDNEDAESFYNKFYDLLAEIMPKYKAEGKTSVTIAIGCTGGQHRSVAFAERIGKAFSDAYAVDITHRDIKKHKETVNRS

SEQ ID NO: 6779 - protein, 342 aa, Lactobacillus casei
MSRETKFIRVIRGRRPKVVVIGGGTGLPVILHSLHEQDADVTAIVTVADDGGSSGTIRNYINVVPPGDIRNVLVALSELPSLYLDIFQYRFNTTDAFFAGHAIGNLIIAALSEMKGGIFPAVQQLSEMMQVDGHVYPASNTPLTLNAEFTDGTSLSGESEITAAGKNIKHISISETDPANGEPKAVHEVIDAIMDADVVVLGPGSLFTSILPNLMIGNLGDAVKKTQAEVIYIVNIMTQKGETQNFTDADHVRVLNEQMGEDFVDTVLVNIEPVPENYLDHQKYNEILTPVKHNYQGLRDMGCRVISEDFLKLRDRGVFHDGDKVAKEILNLAFQVSAKIRR

SEQ ID NO: 6780 - protein, 315 aa, Lactobacillus casei
MASFASMVKKELTQLEVHPEHAKAELSALIRMNGSLTLMAHRFVLNIQTENPAIARRIYSLIRQVYRHEANLVVHRKMKLKKNYQYIVRLTEGVNDILSDLSILDPTTMAISTTVPATVLEEPQRMRSYLRGAFLAGGSVNNPETSRYHLEIYSLYADHNAGILKMMNHFNLNARTVERRSGYIVYLKEAEKIADFLQVIGATNAMLKFEDVRIVRDMRNSVNRLVNCETANMNKTIDAAQKQIENINYLKDHVGLDNLPTKLREIAVLRLAHPDVSLQELGAMVPGGTISKSGVNHRLRKLNQIAEGYQQPEDA

SEQ ID NO: 6781 - protein, 151 aa, Lactobacillus casei
MVKPITLNEQLCFAIYKAQKQYNHFYAQALAPFKLTYPQYITLLSLYEHGTMSVKQVGQTLELDSGTLTPLMKRLEKDGWISRKRSTEDERRVDVSLTQKALDARDEIFEHVGSCMELMNLPQTEYDRIKTEVTRVDEHLSAIADDAYPQV

SEQ ID NO: 6782 - protein, 196 aa, Lactobacillus casei
MLVPTVVEQTSRGERAYDIYSRLLKDRIIMLSGEVNDQMANSVIAQLLFLDAQDSEKDIYLYINSPGGVITSGLAMLDTMNFIKSDVQTIAIGMAASMASVLLAGGTKGKRFALPNSTILIHQPSGGAQGQQTEIEIAAEEILKTRKKMNQILADATGQTVEQIKKDTERDHYMSAQEAKDYGLIDDILVNKNNQK

SEQ ID NO: 6783 - protein, 345 aa, Lactobacillus casei
MHTELAWLKAIAPDLMGVVTKRYQVLQFINWMAPVGRRTLAEQMKISERALRTETDFLRGQGLLESSKSGMVLTAKGLETFHGLDHLMNQLLGIKDDEKRLATHLGIDHCLVVSGDADQSSRVLDELGKTLNSTLQLLLPPGHLTVAVMGGTTMAHLATQLTFQLSAGRELSFVPARGGLGEAVTIQANSIAAAMAEATDSKYRALYVPENLSSESYESLIKEPSVRDVLNLIDKAQVVIHSVGDALVMAKRRGMSPDTISMLKAKHAVAEAFGVFYDAKGKVVYKIPQIGLQLADLDHIPYVFAVAAGKSKAKAIAAYMQHAPSRTWLLTDIGATNSILTGATR

SEQ ID NO: 6784 - protein, 340 aa, Lactobacillus casei
MTVKIGINGFGRIGRLAFRRIYELGAKSNDIQVVAINDLTSPTMLAHLLKYDSTHGTFPGEVSATDNGIVVDGKEYRVYAEPQAQNIPWVKNDGVDYVLECTGFYTSAEKSQAHLDAGAKRVLISAPAGKMKTIVYNVNDDTLNADDKIVSAGSCTTNCLAPMAYFLNKEFGIEVGTMTTVHAYTSTQMLLDGPVRGGNLRAARSAAANTIPHSTGAAKAIGLVIPELNGKLQGHAQRVSVVDGSLTELVSILKTKNVTADQVNEAIKKHTENNPSFGWNEDEIVSSDVIGTTYGSIFDPTQTEVTTAGDYQLVKTVAWYDNEYGFTCQMIRTLLKFATL

SEQ ID NO: 6785 - protein, 396 aa, Lactobacillus casei
LAKLIVSDLDVKDKKVLIRVDFNVPIKDGVIGDDNRIVAALPTIQYVIDHGGKAILLSHLGRVKTEEDKAKLTLKPVAQRLSELLKKPVTFVPATRGKELEDAIAKMNDGDVLLMENTRFEDLDGKKESGNDPELGKYWASLGDLFVNDAFGTAHRKHASNVGIASNMKQTAAGFLMEKEIKFLGDAVDNPKHPFIAILGGAKVSDKIGVIENLVPKADKILIGGGMTYTFYAAKGMSIGNSLVEKDKIDLAKKIMDQAGDKLLLPVDSVVAPEFSNDAPHKVVEGDIPDGYMALDIGPKTIQEFKDALQGAKTVVWNGPMGVFEMSNYAEGTLEVGRALGDLKDATTIIGGGDSTAAAKQLGIAPKITHISTGGGASLEYLEGKTLPGIAAISDK

SEQ ID NO: 6786 - protein, 251 aa, Lactobacillus casei
MRTPFIAGNWKMNKNPKETQAFLDAVKGKLPDASKVETVIGAPAIDLTTLVAGAEGTPLKTAAENCYFEDEGAYTGETSPKALKEMGVDYVIIGHSERRGYFHETDEDINKKAKAIFKNNLLPIICCGESLTQREAGQTEDWVASQIEAALAGLTADQVKVSVLAYEPIWAIGTGKTATADQAQEVVAHIRATVEKLYNKDTADAVRILYGGSVKPANVKELMAKPDIDGGLVGGASMDPESFIALANYQD

SEQ ID NO: 6787 - protein, 434 aa, Lactobacillus casei
MSIITDVLAREVLDSRGNPTVEVELYTEDGGFGRALVPSGASTGEHEAVELRDGDKDRFGGKGVLKAVGHVNNEIAKAVIGLDVTEQRLIDQTMIDLDGTPNKGKLGANAILGVSLAAARAAADEVGLPLYQYLGGPNAHVLPTPMMNVLNGGAHSTNTVDFQEFMIMPVGAKSVREAVRMGSETFHALQALLKSKGDITAVGDEGGFAPNLKDNEEAFELLVEAIKKAGYKPGDDIALAFDVAASEMYDADTKTYTTKWSNPDKKYTTEEWTNMIDGYINKYPIVSVEDPIDENDWEGWQSFTKKMGDKVQIVGDDLFVTNTDYLKKGIDMGVANSILIKLNQIGTLTETFEAIEMAKEAGYTAVVSHRSGETEDTTIADLVVATNAGQIKTGSMSRTDRIAKYNQLMRIEDQLGAQSQYKGRKSFYNVKAID

SEQ ID NO: 6788 - protein, 526 aa, Lactobacillus casei
VARIIKEKEKFDITRLRFVLLGLLVGLMTGTVVSAFRYCIEVGLRASHQVYGYLHMGPFVWWHWVLLIAFNLVLAALVALMLKQEPYISGSGIPQVEGQLAGELEMHWWAILWRKFVGGVLALAPGLFLGREGPSIQLGAAVGQGLAGGFKLRGTDRRLLIASGSAAGLAAAFNAPIAGTLFVLEEVYHNFSPLVWLTALAGAIGSDFISLYVFGLVPVLHLSYSRSLPVTSYWHLILLGILLGLLGYLYQRVLLSMPRWYQRLTHLPRVVQGVVPFILLIAVGYFTPNLLGGGNSLIVGFGQYVPPLLTLLGIFVIRFVFSMISYGSGLPGGIFLPILSLGAIIGAIYGVVMYQLGLLPHVYIMNLIIFSMAGYFAGIGKAPFTAILLVTEMVGNLTHLMPLAVLSLTAYLVVDLLGGAPIYEALLEQMTFPKTVEQLHQPDRLEIPVFVGSSLNGKLVRDMPWPKESLLIGIRRGEREVIPHGDTLIREGDTLVLLTDAAERVRVKKRIDALSAALATEHKTRT

SEQ ID NO: 6789 - protein, 122 aa, Lactobacillus casei
MRTFRIVYAVASILLGLFYSVGGELGLLTSSGDGFASFIVPFLLGFVANWGMVALVIVGVIIDKQMRWWYLGYPVLMGLNIGLNQMLPVSVADQVSYLMPFLVAVIGGYMLYQTFRKKPHIA

SEQ ID NO: 6790 - protein, 78 aa, Lactobacillus casei
LQSLLTTLLVIDSIFIVIATLMQPSKQQDALSALSGGATDLFGKTKSRGFEAFMEKVTVVLGVIFFGLAIALVYLEAH

SEQ ID NO: 6791 - protein, 244 aa, Lactobacillus casei
MIFRKPQPFEYEGTDTGVVLLHAYTGSPNDMNFMARALQRAGYGVYVPLFAGHGTIEPMDILTKGNPDIWWAEASAAVAHMTAKYTRVFVFGLSLGGIFAVKALEKLPGITAGGVFSSPILPGKHHLIPGFLKYAQYMNRLANKPDESTQILAYLPGQLAAIDQFATGVAADLDLVKQPTFIGQAGEDELVDGRLAYQLRDALINAARVDFHWYDGAKHVITVNSAHHALEQDVIEFMQQENEG

SEQ ID NO: 6792 - protein, 789 aa, Lactobacillus casei
MTTVGHIRNELLATFRRNPKIDYSVQTLSRALKLNEGADFKVLVQALNGMENDNLIHANHEGRYALGGAPKVLTGVFHGNEKGFGFVAVEGLDDDVYVPSTSTDFALDGDTVEVRIVREARPNDSRGAEGEITKVVQRSLTTLVGEFKPFSDKDRAKSGFIGMVVSHEKKLKNYPVYVKDTGTIPQLGDMTVTEITEFPTEYHPKLMYGMVVETLGNKNDPGVDIMSLVLQNHIKTEFPDEVMDQTNAIPDHVTPEERVGRKDITDQAVVTIDGDDSKDFDDAVVVWKLPNGNFHLGVHIADVSHYVTEGSALDQEAFDRGTSTYLVDRVIPMLPFRLSNGICSLNPGVDRLAMSCDMEIDHEGHVVSHEIYQSVIKSHARMTYNNVNKIVTDHDPEVMAEYQELVPMFEDMVELHQILYKMRHARGAIDFEENEAKIIVDDMGHPTDIVLRERGVSERMIESFMLAANETVAEHYNKQHLPFLYRVHETPDADRVKEFMEFIASFGITVPMKKGKEITPKQLQEVVTDVTGTPEEAMVNVKLLRSLKQARYSPDPLGHFGLAAKYYCHFTSPIRRYPDLVVHRLIRDYATEGVGDDVQASWNKKLPDIATQASMAERRSIDAERAVDDLKKAEYMADKVGEEFDAVVSGVTSFGMFVALPNTVEGLVHITRMSDDYYSFVESQMALVGERTKRTYRVGQSLRVKLDNVDIDQRQVDFSLIPDDKTPTSDLGKLVKKDDRRDRRSNGNRPSFGNGNRGGNRNQHNNQRPRKPAGAPHQGKHYNAKRGAK

SEQ ID NO: 6793 - protein, 157 aa, Lactobacillus casei
MAKKHRQKPDNLLAQNKKAGHDYNILDTYEAGIALTGTEIKSVRDGKINLRDGFARIRNNEAWLENVHISPYKEGNLFNVDPMRNRKLLLHKKEIRKLGQLTARQGVTLVPLRMYLKHGYAKVLIGVAEGKHNYDKRETLKRKDQEREVQRALKARY

SEQ ID NO: 6794 - protein, 581 aa, Lactobacillus casei
MNLAALAHRPESEDSFLYTDKTLHLRFHTARQDVAKVTVLYGDPYWRIPDAHGADQLVYQRETMTLLGTGQVLDHWVVTLEAPYRRLQYLFEVTGQDGTVWLYGDRGLRKDSADARHEAENYFRMPYFQAIDRVKTPDWVKTTVWYQIFPERFANGDPNNDPDGTKPWHPTDHPGREDFYGGDLQGVLDHLDDLQALGINGLYFCPIFTATSNHKYDTIDYLNVDPAFGDKALLAKLIHAAHQRGMRVMLDAVFNHMGYGSLQWQDVLRNGEKSRFASWFHLHQTPVTPFHNPLKGEGQPQYDTFAFEEKMPKLNTANPEVQDYLLMVATYWIKTFDIDAWRLDVANEVDHHFWKKFYHAVTAIKPDFYVLGEVWHRSQAWLNGDEFSGTMNYPFTQQIEDHFFKRRRTAAELVALLTDQLMLYRDQTNQVMLNMLDSHDTPRILTLAHGDEDLALQALAFTWMQTGSPCLYYGTEMSMSGGADPDNRKPMDWAKLGQPIWKRVAALVHFRRQHATTLGTGTTRLSVTDTGLIKVVRQGNEMLTGYFNTTEQPVAVNREAVFAQGFVNGQLAPKGFMVVAG

SEQ ID NO: 6795 - protein, 753 aa, Lactobacillus casei
LKRLFEIDPWLVATHHLDKIDRRLQESITAVGNGYMGLRGNFEEGYSGDSLQGTYLGGVWFPDKTRVGWWKIGYPEYFGKVINAPSFLGIGITVNGEQVDLATSRYRDFYLALDLHQGLLTRRFVYIGDGVEVQFEFARFLSQTIKEAAFVSVKATVLRGHAAMTFDASLDGQVTNEDSNYDERFWVPLHEDAAAKSIQLQTKPNPYGVPQFTVLLKQQLRVNDQPVNGQVATTSGQLHEQVTVQLAEGQSYQLEKDAIVVTSRDVAPAAQATAAAQLMKQVTAQSFAAHLAAHTARWDQRWAKSDVVIEGDPAAQQGIRFNIAQLFMTYYGEDKRLNIGPKGFTGEKYGGATYWDTEAFIVPMYLAVTPSEVTRALLQYRHDQLPGAFHNARQQGLAGVLYPMVTFNGIECHNEWEITFEEIHRNAAIAFAIYQYTAYTGDESYVKHDGLEVLVGIARFWADRVHFSQRTQQYMIHGVTGPNEYENNVNNNWYTNTMAVWELQYTLERLAKGDADIVAALAVTDQEKQHWQAIIDHMYYPTDDQLGIFVQQDDFLDKDLRPASTIPADQRPINQHWSWDRILRSPFIKQADVLQGLYFLNDRFTKAEKERNFDFYEPLTVHESSLSPSIHAVLAAELGKIDKATELYARTARLDLDDYNHDTQDGLHITSMSGSWLAIVQGFAGMRYDHDQLRFHPQLPKNWRRYQFKLNYRGRLLAVDVGQKVTVSLLAGPSLDITIDGKTVHLEVEDGHA

SEQ ID NO: 6796 - protein, 220 aa, Lactobacillus casei
MLKGFIFDLDGVLTDTAKYHLAAWHELAERLGIHLPPEADAALRGRARMDSLELILRYGHQERNYDEAQKVALAEEKNLRYRALVASITSADILPGIPLLLEKAKQHRLKMAIASASKNAPMILQRLGLASQFDAIVDPSSLHRGKPDPEIYIKAQQLLQLQAAEVISFEDAPIGIAAIKAAGQFAVGIGDADKLAAADYRVSTTDQLDYDRIVAAFERR

SEQ ID NO: 6797 - protein, 100 aa, Lactobacillus casei
LRKMDEMERKFADRSIRIAYLMMFLMLWSSGTYELIRTGQTNFDFFVVNVAMVVQIASYEWFKHHADQTDKEPGRVFYLTIALVAIILTLGLLSLMFHGK

SEQ ID NO: 6798 - protein, 413 aa, Lactobacillus casei
VTTIRFLNGLNTIGGNIVEFATKTSRVIMDFGVAADLSQETVASALEQGKLPHVPELFFNQPDHFSDEAIFISHLHIDHMGALQYLQKDIPIYLSEPSYRLYRLLIQLGIEKPVANLHPLAFETPLAVGDLTVTGFHSDHDEPGVMALLVDDGSRRFAHSGDVRLNGPHADRVHAWAKRFKEEKVSLLMLEGTSFSFDTPIPVEDQDHPSVPLTEMSLQTKFQQLLADSSQLVVINPYNRNYERLEAFQVSAHVNGRQMVWEPNEAAILTSMTGTQPDAILGQTIQLTDIAQQPQRYVLQNSFANLASLANLPISAYVHSNGEPLGDYDPRFAQLKDWLADHQIPLVFMNASGHAAREDLIELVKEVNPRVVVPWHSFHPEREADAIDAQTNADVLLPEKDLYYDFDPLTEEE

SEQ ID NO: 6799 - protein, 438 aa, Lactobacillus casei
MKKQNWVKRVLLAMLTITLVAVLTACGSNSSSKSSSTTKSDSGKRVTITFWHGMNGPYQKAINQIITDFNKSQKQYKVVGTAQGNYTALQQKIMAAAKSRNLPTIAQTTYTTVPDYVKNGFITPLDQYMLKGDNKMSASDLKDIYPAFLSSSKYQGKYYSVPFSKSTRILFYNEALMKKYNIDKPKSWEDIKKDADKLKADGVAAIGFDKSFDMEFEGLARQAGNPLISAKPLKANLDSKKTITAANFIMDMVNNGEAKTAGEDIYGDKNFTSGKTLFYAGSSAGITNMKQNAPKDFKWGTMPLPSYKGKKATELAGNDIVLFKSASTDQQKGAWAFMKFLLSEKETSKWAQLTGYVPLRKSAVQSADFKKYLNENETSKAAVDSLGFGFQSTAFIGFSEYRNDLLNAVDAMLTKHEKPEQALKTLQGQAETIIKTNK

SEQ ID NO: 6800 - protein, 273 aa, Lactobacillus casei
MAKKLSKVLLYLIVILGAITMLIPFLWMISTSLKTAPETIAVPPIWIPKSLQWGNYVKAWNEAPFGQYFINSIIVTVVTTVGQLFTSILAAFAFARLKFYGKNILFIIFLGTMMIPGEMLIIPNFVTLSHLGQIDHYGALILPWLASFFTVFTLRQTFQSTPDQIYYAAKIDGASDWKYLWQVLVPMSKSTITAVTVLQVIGSWNAFMWPLIVTNSDKMRTLPVGLQAFTTDAGTQYQLLMAASTFVIIPMVILYIFLQKYIIAGISKAGLKG

SEQ ID NO: 6801 - protein, 297 aa, Lactobacillus casei
MLNEKASLKSTAKAALYLLPMLVITITFNIWPIINSFLMSLYTKYDFYTDKVSGWGFDNFVYLWNDPDFHLAVRNTLVFVVGVVPITVILSLIIALLLNQVKIISGFFRTVYFLPFVTSTVAIAMVWNWMFHGNYGLVNYFLSWFGVHPINWLTDPHYALLALIIMSIWKSLGFNIILFLVGLNNIDHGYYEAAEIDGANARQRFWNITIPMLSPITFLVSVNGIIGSFKVFDEIFALFQGTPGPGKADLTIVYYLYQKFYTEYKYPIAAASGVVLFFLILLVTLVQLWYSRKHVHY

SEQ ID NO: 6802 - protein, 353 aa, Lactobacillus casei
LKVTFKDVTMSYDGKTDTLKDLNFTIPDGTLVSLLGPSGGGKTTTLNLISGLLSPTAGQIFFGDTDVTKKDALARKVGMVFQNYSLYPHLSVLDNIAFPLKMAKVSKAERHAKAKDLAKLVHVEDQLDKKPGALSGGQQQRVAIARALAKSPSLLLLDEPLSNLDARLRIEMREEIRRIQRETGVTTIFVTHDQDEALHISDNIMVLANGSIQQFSSPQTLYDQPNNLFVAKFIGEPVINTIPAQALAADLAGAVPEDILKQAETAGIRSEALIPYDAGENVLAKLHGKITQSSKYGREATANITYNGEHLLSTEMAGVSGSQPELDFYLTKSGFFLFDQSGALIFGGESHAK

SEQ ID NO: 6803 - protein, 190 aa, Lactobacillus casei
VIIRPSKPADAAQVAPLIDIVFTEMEIPQLMRVPKKTLYAVLQQAFLLPTYRYGYPQMLVADQNGKIEGIAVGYLHEQEAHIDDALQPLLPKLGLTPQSLLFTDTETYPGEWYLDTLAVAPSAQGHGIGTKLLQAVDPVARSRKADVVSLNVDQQNPRAKKLYERNGFVKNGELMIGSHRYDHMVRPVGE

SEQ ID NO: 6804 - protein, 168 aa, Lactobacillus casei
MALYLDINALSTGSLSVVKTDNGKPAYILTARHGLINGGFDLNTLSGNPLGSIRQKTVSVFPRYDLYIANRNVASVKKMFGVWHQFIFISKLNWVAMGNLLNNHYQVFHGVKTIFSAEEVAPAIVKLTIPNNRDIPAAILLAAILDRFRHVGVADPLKRYEYGLDFPD

SEQ ID NO: 6805 - protein, 297 aa, Lactobacillus casei
MIKLIASDMDGTLLNDKMEVSDENAKAIREAQAAGIEFMVATGRGVTEAKPLLAAQQLKPAFITLNGAMVFDEAGKPVVTIPIADDLSQYVIDTLQAADIYFEITTNKGVFSDSRVKRIQNVADLLVDLNPDTTYKLAVALAAARLEIMNINYVDDYQKLLDDPTIKIMKIIAYTGETPDILKAPAKVFKATGKLSVTSSSVNNIEVNNIKAQKGYAVEAYAKQKGITMDEVMAIGDNLNDASMIKMAKYGIAMGNAIPEITDLAWGTTGTNGENGVAEAIRKAIRINKAEATNARF

SEQ ID NO: 6806 - protein, 229 aa, Lactobacillus casei
LKTLIHNDWQTVLEPIFESPEYARLHEFLKEEYTTKTIYPEMHHIFQAFEWTPFHDVKVVILGQDPYHNPHQAVGASFAVAPGVALPPSLQNIYKELQSDLGYPPVHHGYLKAWADQGVLLLNAVLTVQAGRAYSHQNHGWEELTDAAIAALSARGGVVFILWGNAAKKKAALIDTSKNAIIASAHPSPLSASRGFFGSRPFSRTNEALKKMGETPINWQLPETVTAAS

SEQ ID NO: 6807 - protein, 325 aa, Lactobacillus casei
LDLFESLKDKINDKHLRIVFPEGEDPRVLGAAVRLTADGLVQAIVLGNPEKIHNLATEKSWDLSKLTVRDPEHDDLHAKMVTAFVERRKGKATPEQAEKIVQDANYFGTMLVYMKEADGMVSGAVHSTADTVRPALQIIKTRPGVHLVSGAFIMQRGRDERYLFADNAINIDPDADQLAEIAVESAKTAALFDIDPPRVALLSFSTKGSAKGPQVDKVVAATQKAHELAPDLALDGELQFDAAFVPTVAKQKAPESKVAGEANVFIFPELQSGNIGYKIAQRFGGFEAIGPILQGLNQPVSDLSRGANEEDVYKLAIITAAQTLL

SEQ ID NO: 6808 - protein, 154 aa, Lactobacillus casei
MTSLKKDFTSEAELQAFAASLGPHLQAGDVLLLDGDLGAGKTSFTKGLAKGLGITDYVKSPTFTIIREYRHGRLPLYHMDLYRLEDGGAEDLGLEEYFEGDGVSVVEWPDFLGASEPEADLLVHFQKDEQSDTTRHLEFVPQGKRYETLLQSLK

SEQ ID NO: 6809 - protein, 298 aa, Lactobacillus casei
MLAVKDLVKTFGTMTAVDDVSFTVKPGEIMGLIGQNGAGKTTTFRMILNFLTPDAGTITWNDHPLTAKDYDIIGYLPEERGLYPKMRVQDQIIYFARLRGMKTADVKARIPEWLERFQVKGKATDKIKDLSKGNQQKVQVIATMIHMPKLVILDEPFSGLDPVNAGLLMVGIEMLKDNGAAIIYSSHDMANVEAISDHLVMLKQGKMVLNGAVGDIRESFGRTKLFIESGLTRDDLQAFDGVTNIRQHGQEFELTLADPAVGRQIFEKAVANGYIPEFRQQPPTLDEIFRLKVGETHA

SEQ ID NO: 6810 - protein, 419 aa, Lactobacillus casei
MHKFWVVMSQVYKKNAKSGSWIFLVLSPLLFLAIGFGIAFYIAKTQAPAQVAVVSDVSAVSQALSKQNNDDLHFKVYSSSKKADAALNDEKVDGILTVNAKDQFRSRYVSRDNGQEVDKTTLVTALSGLKLSSTAASMHLTAAQVSALTQPPMVSTKTVAIENGKQVTKSNSTQLMNHGVAVVAMILILMVTMVYGSILAQEIATEKGSRIMEILLSSVSATTQFFGKLAGIFALLLTQLAIYVVAGVISWQFVKNQSFVSGVLKQFDFSILVSGTTAMIVVFFIIGTLTYSVLAALTGSLVSNQEQVQQAAMPISMLGLIGYFITIAAQSSDSALAQITSYVPFLNVFVMPTQMSLGRASMGEAWISVAISLVFLVLFTMFTVKVYRNNVLVYSGSGLWQSMKTSFSIWKSEHSVAKK

SEQ ID NO: 6811 - protein, 180 aa, Lactobacillus casei
MDFIAMDFETANRKRASACSLALVVVQQNRVVDSFYTLINPQMRFDPQNIRIHGITPDMVQNQPTFDQVWPHIQMFYTPGRIVTAHNAPFDVSVLRLTLDRYGIAAPRYQVIDTVRTSRQFLPKLPNHRLDTVSAALKIPLEHHHNALADSYACARILIAENEHFGEARTKVMMKLAKAG

SEQ ID NO: 6812 - protein, 252 aa, Lactobacillus casei
LKLISWNVNGLRAVLKKDFMTIFNELDADWFCLQETKMQEGQVTLDLPGYYQYFNYAERKGYSGTAIFTKHKPLNVTYGMGIPEHDKEGRIITLEYPKFYLMTVYTPNSGGELKRLDYRQQWDKDFRDYTNQLAAKKPLVYCGDLNVAHEPIDLKNDKTNHHNAGFTDEERADFTKQLKSGFIDTFRHLYPDTVTYSWWSYRFHARANNAGWRIDYFVASSNFQPYVKDAKILTDIMGSDHCPVELTTQDLL

SEQ ID NO: 6813 - protein, 300 aa, Lactobacillus casei
VVDAPRMLEGITIMHDEPLSHYTFTKTGGPADLLAFPKNVAEVRTLVESVREQHLPLTVIGNASNLIVRDGGIRGLVLILTAMNEITVTDNTVTAQAGARLIDTTEAAYRAGLTGLEFAAGIPGSVGGALFMNAGAYGGEVCNVISSAHVLTRAGEFKTYNHRELKFWYRHSIVQDTGDVVLSVTFSLKPGDKPAIRAKMDELNARRAAKQPLEYPSCGSVFKRPPHHFVGPMIQKAGLQGHIIGGAQVSMKHAGFIINLGDATATDYLDMIHLIQKTVKAKFGVDLETEVRIIGEPLQS

SEQ ID NO: 6814 - protein, 703 aa, Lactobacillus casei
MHLVEAVLFLMALVIVSNVLSHYIVAVPVSLIQVALGLGAALFFHLTINLATDWFMLLFIAPLLYYDGRHFPRRELWELRGPIIGNAIFLVFATMLVGGYLIHFLIPPLPLPASFALAAILSPTDPIAVQSLAKRTHLPSGVLHLVSGESLINDASGLIGFKYGIAATLTGTFAFGHAVQDFFYVALVGAMAGLVLIGIINLSRNWLLQQGINDVILHTILQVLTPFFIYLIVDEFMHASGVIAVVVAGLLSNTQHNRYVAALPELRIVSERTWDLIVYTLNGIIFLILGIELPVAMRDTIADHEVSTLQALGFVVLVYLGILILRTLWIYGYMLLTVRSKGNQPSWRAALLSGISGVRGAITLVGVFAVPAALANGDPFPERSLMLFIAAGVVVLSLIVAIIALPIVTRSVAPLQTRGSTIAATDDETEADEDHANDVRIISLSQAQMFVYQMAVRRVESERRENNQKAALDLIAEYQNLIRRLELAEDTGAAIPPLVQDELDLRKVGVQGELYALDDLWRENKIMSKSYAKARKQLKHRMDDLDSMAKRSGRPTLRMLFDRSALRLSHFWYTVASEQNRSHRFFNEKLFIEKETAKGGLKYLSKFLRQKENKAHHYNRQVIYSLIVQYRNRIASVKALNTHKSTQYEHELSRLRAIAFAAERTAIHDLMEKGYITMTMAQRLNQNVNFTENAATLTSLEEV

SEQ ID NO: 6815 - protein, 179 aa, Lactobacillus casei
MDIGSKIRDLRIRKNLTQEELGERTDLSKGYISQVEHDQSSPSLETFFDILSVLGESPADFFREEPVDSLVYHEEDQVTYLDEDKGYQLKWLVPESNENEMEPVMIDFAPDGIFKTFEPSPAETFVYVVSGKVKLLLGDQAYVAKKGETIYFHATKQHQLVNAATGRSKCLLVATASYL

SEQ ID NO: 6816 - protein, 362 aa, Lactobacillus casei
LSNIIVELKHVGKRYGDTQVLKDVNIEIEQGKFYTLLGPSGSGKTTILRAIAGFLDVSEGEVLFDGKKINDVPANQRKVNTVFQDYALFPHLNVFDNVAFGLRLHRMSKETIQTKVTDALKMVRLQGYADREISELSGGQQQRVAIARAIVLEPQVLLLDEPLSALDAKLRKDMQYELRELQERLGITFLFVTHDQEEALALSDEIFVMNDGQVQQSGTPVDIYDEPVNHFVADFIGESNIIPGHMIKDFLVEFNGKQFECADAGMRPNEPVEVVLRPEDLDITAADAGKVNVEVDTQLFRGDYYEIVAYDQLKNEWLIHSTNPAKDGETVGLTFDPEDIHVMRLNESEEEFDARLETYEGD

SEQ ID NO: 6817 - protein, 274 aa, Lactobacillus casei
VKKSTTNVAFYTPYVMWLALFVIAPMVLIVYQSFFDISGHFTLANYQTYFQSGTYIMMTINSVWYAFLITFATLLISYPTAYLLHYAKHKQLWLLLIILPTWINLLLKAYAFIGIFSQDGGVNSFLGMFGIAPQQFLFTDFSFIFVAAYIEIPFMILPIFNAIEELPENLVNASQDLGAKGWQTFTKVIWPLTISGVKSGVQAVFIPSLSLFMLTRLIGGNRVITLGTAIEEHFLTTMNWGMGSTIGVVLIVAMFIIMFLTGERKKKGVRRHEA

SEQ ID NO: 6818 - protein, 277 aa, Lactobacillus casei
MKRKFKWSNLYLIFVFICLYVPIFYLVIYSFSTGDRMSNFSGFTWKHYAELFADTRMIQIVLDTLLVALLSSLIATIIGALGALAIDRTSRPVMKNTVLSLNNILMVSPDVIIGASFLIFYTALKVPLGFWSVLMSHIAFSIPIVVLMILPRLQEMSHSLLDAARDLGASNYQVLTRVIVPYITPGIFSGFFMAFTYSLDDFAVTFFVTGNGFETLAVEIYARARQGISLEINALSGVMFVFALLLVVGYYFLQRAGQSRRAKHKRESEALINETTH

SEQ ID NO: 6819 - protein, 357 aa, Lactobacillus casei
MKRLISIAVAILAVCLGLAVWSQDLQKSQGNTGDNTLNLFNWGDYIDPALISKFEKQTGYHVNQETFDSNEAMFTKIQQGGTSYDLTVPSDYMIEKMKKANLLLPLDKSKLNGMQNMDPRLINKEFDPGNKYSIPYFWGTLGIIYNDKFVKASEVQHWNQLWNPKFKDSIMLIDSARDVFAPALISMGQSVNETNPQTLAVAKAKLDQLSPNVKAVVADEIKMYMAENEAKIAVDWSGEASEMLANNKHLHYVVPREGSNLWFDNLVIPKTAKHFKAIYAFLNFMMEPKNAAQNAEYVGYATPNAAAKKLLPKRVQNDRQFYPDDETMKHLEIYSDLPPAKVGLYNDLFLEFKMYRR

SEQ ID NO: 6820 - protein, 63 aa, Lactobacillus casei
MRKHSRHNEGLWLDIICCLSLWLAVVCLLLAALAIKVNRPYIIIMLAFGLCALGETVTVFKKW

SEQ ID NO: 6821 - protein, 937 aa, Lactobacillus casei
MKSEKETRRKFATESVADLLNDLHTTSTGLSQKEAAARLAKYGENTITREKQKSQLLVFLKNFTSVMAILLWVSGFVAILSGTLELGIAIWLVNVINGIFSYWQEHEAQKATDSLMKMLPTYTQVYRDGKLQQVNATQIVPGDVFNLQAGNAVPVDARLIKATSVQVDQSALTGESVPESKKVDYNAGQGEFAESNLVYAGTTVGAGTATAIAFATGMKTEFGRIAALTQQQKRSLSPLQLELNRLTKQISLIAISLGVLFFVAAIFFVHYPVAQSFIFALGMIVAFIPEGLLPTVTLSLAQGVQRMAKKHALLKDLNSVETLGETTVICSDKTGTLTQNQMTVDHIWTRSHTYTVSGQGYVNNGHIELDGKPVQYGSDPDLDLLIRLVAFNNDTEVEPAKGQARPKILGTPTEASLVILAQKSGIDVNAYTKKYPRLKELPFDSDRKRMTTIHQHDDHTLSICTKGSLSDLLPHCDTIQENGKVRPLTAADKDAIDAANRKYASLGLRSIATAYREVPQEADKQSQLDNLTIETAETKLTFVGLAIMSDPPRPEIYDAIEKCHRASIKIIMVTGDSSLTAKSIAVKIGLTSDKARVVTGSELDAMSQDELKQALAGEIIFARVAPEQKYKIVSTLQTMGEIVASTGDGVNDAPALKKADIGVAMGVTGTDVAKDAADMILTDDNFASIVAAIEEGRTVYSNIQKFLVYILNSNLPEAVPSALFLFSRGAIPLPLTVMQILTVDLGTDMMPALGLGSEKAEPGIMDKPPRARDAHLMNRTVLWKAFAWYGLIASIISSGAYFFVNHLNGWPLRGLATSGSTYVMATTMTLAAIIFCQIAAAMNCRTENASVFKVGLFTNHLVWFGIGFEIFLLALLSYTPFLQNLFHTGPLALTDWLFLAIIPIPLFLIEEGRKWLNRRRLSREKVTATARASSATR

SEQ ID NO: 6822 - protein, 216 aa, Lactobacillus casei
MIVQPHNLTDLFSSSLAESQLSAKQQAVLKASLSLFSEKGFDRTSTKDIAHLAGVSEGTVYKQFKTKEGIRQALLAPMIQQVIPNAFTEFIHEIGEQQLPDLHTFLTFIVHNRMAFAIENQAQLRILAATLLQDAALSQALAEKFQKQFIDKAVQLLAFYQQEGALVNWPLTRILRYLFGTILSYLLPVILEMQSDFDLETAVSEAVAFLERGLHA

SEQ ID NO: 6823 - protein, 380 aa, Lactobacillus casei
MRVNALISRIFKEMIRDKRTLALMFIAPLFIMTLIFFLFQSNTNTKADLGIHGVDTSVVQALDTDRIRLHHVGNEDLTMLIKDHDYAGILTQKGDKLTLLLANADQGKSALLKQGLQAATIKLKMQAAATTIKNQATALQKLASALQHSTRGTAQVAGSQPASTATHYRIATHYRYGSANSTYFDTLLPILIGFIVFFFVFLISGIALLRERTTGTLDRLLATPVRRGEIISGYLLGYGIFAVIQTILIVGYALFVFKIQILGSIAAIFLINLLLAITALSLGLLISTFANTEFQMLQFIPLVVVPQIFFTGLIPVNQMLGWLQPIARLMPLYYGADALTGIIAKGQSLSVLYPDVIALLGFFLLFLSLNLVTMRHYRQV

SEQ ID NO: 6824 - protein, 245 aa, Lactobacillus casei
MSREPVVQVIALQQGYGQKIVLSDIDLTLNPGQILALIGPSGAGKTTLIRTIMGMIRPRSGQVLVFNRPVPNRLLLARIGFMAQTDALYESLTGAENLTFFAKMQGVKQTQMAEQLRYAAHVVNLQSALDQSVKTYSGGMKRRLSLAIALISKPPLLILDEPTIGIDPELRRKIWQELHRLASDQGVTIILTTHVMADAEEADLLMMIRNGKAIAQGTPDQLKATYHTDSIEAVFLAAGRQQDAR

SEQ ID NO: 6825 - protein, 285 aa, Lactobacillus casei
MRTYLANLLTWSTLINLVDILVVWYVIYRLIMLVRGTKAVQLLKGVFVIAAIKIISWFLQLKTVGYLTDLVITWSVPALVIIFQPEIRRGLEHLGRGSLIFRSNNNQHEAETRMVKELDKAIQYMSKRRIGALITIQKNTGLEDYIETGIPLDADISGELLINIFIPNTPLHDGAVIIRNNRIAVAAAYLPLSDSNLIPKELGTRHRAAVGISEVTDALTIVVSEETGEVTITNNNNLIRNLTREDYMKFLTAQLVPKEEAPNPNPVVSFFSRLFSQRKKKEGKQ

SEQ ID NO: 6826 - protein, 367 aa, Lactobacillus casei
MNRLWDKPWVNRLLALLLAIGLFAYVNVESINNTRQNANDDTTLVANKTQTVKVPLQVNANTDKYFITGYPSKVSVALTGTASLVTMTANTQNFRVVADLTNLGVGKHRVHLKAEGLNKDLSYSISPKSVTVDIQVRDNKTMPIQVRYNKASIASGYAAGDPKLSARTVEVTGARSVIDSIAQVVANVSLAHNTRKTVDQEVLLQALDDNGNTMNVVLSPQTVHVTLPISQPSKKVNIELKQTGNAASGHTYALSSDTKQVTVYGDQQSLDKLSKLTVPVDISGITSTTTRTFNVTDLNDSISAADPKTIKVTVSVGNTGTGNGGGNDDDDVGTNANAGTSTASSNSSSASSSQSSSSSESTSASEK

SEQ ID NO: 6827 - protein, 454 aa, Lactobacillus casei
MTKYFGTDGVRGIANKELSPEMAFRLGRTGGYVLTQHKEDASHRPLVLVARDTRISGQMLADALIAGLLSVGIEVLDLGVITTPAVAYLIKIQGADAGIQISASHNPVADNGIKFFGADGYKLSDETEEEIEALLDAPEDNLPRPAAEGLGTVDDYPEGALKYTQFLEQTLSDDLSGIHVCLDGANGATSGLVSRIFADLDTDFDTMATSPDGLNINADVGSTHPQALAKFVVEKGADVGLAFDGDGDRCIAVDEEGNIVDGDKIMFILGSYMKSQGRLKQDTVVTTVMSNLGLYKALEANGMKSVQTAVGDRHVVEAMRKDGYNIGGEQSGHIILFDYHNTGDGMLTGIHLLNVMKKTGKKLSELAAPVQDYPQKLVNVKVADKDNWQAYPEIQEAIDTVEKEMAGDGRVLVRPSGTEPLLRVMAEAKTEDLVSRYVDQIVAVVKREMGSQKD

SEQ ID NO: 6828 - protein, 606 aa, Lactobacillus casei
MLTMCGIVGVIGKKNATQILLKGLEKLEYRGYDSAGIYVNDQAGHDHLIKRVGHISNLEKAVTPDVQGVMGIGHTRWATNGGPTEANAHPQVSNDERFYLVHNGVVTNANDLKQQYLQDIELHSDTDTEVVVQLIALFARQGLSAKEALRKILKLIQGSYAFSMVDRLDPTVLYVAKNKSPLLIGRGKGFNVVASDALAMLSETDQFVELKDQEIVTLTADTIHIETLDGKVEERKPFTVKVDDGEVSKGTYPFFMLKEIDEQPIVMRRLVEKYTDDQHHVVIPEDLMKALQQADRLYIVAAGTSYHAGLVGAPLFEQLAGIPAEVHVASEFAYHQPLLSKHPLFIFLTQSGETADIRQVLVEVKKQGYQTLTITNVGSSTLAREATFTLLLHGGPEIAVASTKAYTAQIAVEALVAKAVGEAKGLQAAKDFDVIHQLGLAATGQQALIDQKDRIHELATDMFKTTRNAFYIGRGGDYYASLEAALKLKEISYVQAEGFAAGELKHGTIALIEKDTPVVAIISDPVTAARTRSNADEVQARGAKVLHIAMAGQAQKGDQIIVDDIDPLLAPLVTIIPAQLLAYFTSADRGYDVDRPRNLAKSVTVE

SEQ ID NO: 6829 - protein, 601 aa, Lactobacillus casei
MSYPINWNLDSIFPGGIDSPQLAARIQQVADELPQLETQVAAWSPSDDAPEFTDFKTFWQLFEDISKGLGTTGSFVEMIASADTANLKTGPLQGRLTTLETRFQNINNPLTKKLAAMPQAAFDQLTATGTLAESRFGLAEMRDQAKDLLDDQTETMINDLAVDGYTGWSDHYTTLSGSLKFPVVENGKTTELSAGQTQNKFEGAPDPKVRRDVFNVWEHVWNDHASLFAETLNHIAGFRLTDYRLHHYPDYLYKPLQYNRMQRATLDQMWHTISANKAPFAAYLTRKAQLTGQPTMTWYDQWAPVIVGDFKPKTYTFDEAAEFIVSNFAKFSPKMAAFAKHAFENGWIEAEDRPGKRAGGYMTSVPDVKESRIFMTFDGSASGVSTIAHELGHAFHSDILKDMPVLRQDYAMNVAETASTFAELIVADATVKAATDPAEKLNLLDAKMTNPIAMLLNIHARFLFEDSFYQEREHGIVSVPRLKELMTEAQQKAYAGGLSSFDPMYWADKLHFYFDNPPFYNFPYTFGYLFSSGIYAKAQQTANFEDDYIALLRDTANMSTEELAKKHLGVDLTQPAFWQQGIDLAAKDAQQFMQLSEDYLK

SEQ ID NO: 6830 - protein, 164 aa, Lactobacillus casei
VHSFKRHWGLWLTAALLFILFVSSSMTYKEQTTVPLMERLLQSEPFKPFLSTIHFDYAGETQSVAKVGYFKFVEFFIRKGAHVTIFFLLGLGLTQGTFMYQKNRWLHWPLVTLSCTGIAAFDEFHQMLTGGRTPLFQDVMLDTVAAAIAVTVMWGWLWWRRKRR

SEQ ID NO: 6831 - protein, 243 aa, Lactobacillus casei
MSGHSKWHNIQGRKNAQDAKRGKIFQKLSRELYMAAKQGGPDPSGNPSLRLVMDKAKAANMPKDNIKRALDKASDRDAANYDEVTYEGYGPGGVAILVEALTDNRNRTSSSVRVAITRHGGNMAAAGAVSYMFDRKGYLVISREDFDVDEDQMLEDALEAGAEDMQTSDEAFEIYTDPKEFAQVRDALEEKGYKFVQNELTMVPQNLTPIPKDKVEQFQAMIDQLEDDDDVQEVYTAGDWPDD

SEQ ID NO: 6832 - protein, 289 aa, Lactobacillus casei
MQSVNELLTSALAKGASDIYYLPSAQGYLVRLRLPTGLMTLAKREARLGQQEINYLKFMAGMNVAEHRRVQLGAFYQEAPSVFLRLSSVADYRGRESLVVRLISGIPDADGARQLLDRLMSILLQRRGMLTLAGPTGSGKTTLLYQLATRLAESRMVLSIEDPVEINQPQFLQLQVNPEAEMSYPQLLKAALRHRPDVLLIGEIRDRQTAQSACEAAISGHIVLATVHARSAGDTPLRLTSFGLSEELVAAALTASAAITLRYRPVIHPVAELVVFERSSQSQAQEVVS

SEQ ID NO: 6833 - protein, 318 aa, Lactobacillus casei
MKVPLIAQERFCRQSAALITAGFSLPDVFAYLRVSSPKYRIVWERIEAELANGIAFSEAVAHQELAPILFQQLQLAQIHGDLAKALTVAGDYLGLRVRNRQKMTQLLVYPCLLLAMLMVLQVVVVFGVLPALSLPRSELVLVQLGGLAVLIGLCVLIYLVWRRLTPLKRLLVLQKVPGMRQVLRMYYQFQFTSGAAQFLLAGADISDFCRHLATLEGPLGNLGSRIQAKVQRGQELTEALQEPFVPDEVARLLTMGQSRHLVAEGLKLFGEQLFFNLQRQLEKLVNLIQPLLFLLIGGEILLVYLQILLPLYQSLGGV

SEQ ID NO: 6834 - protein, 106 aa, Lactobacillus casei
MRRKKLRAFTLIEVVAALGVIILLTLALVLTIQGQMKRVDTQNLKATVATVNTQLEMTYNEPDQGGVDFSSADQLVKKDVISQSQADALKKGGYKLTSGSPPKFAK

SEQ ID NO: 6835 - protein, 141 aa, Lactobacillus casei
MKRLSGFTMIEIVAVMFILTALALVAVPVGRGVLTHRQEREFMETLIEEWEMLKMKARSDHKNGDMYVKGSKRQVEFATIDGKFRVLKFPSSLTYDGSSTISCNPRGKITQAGSLNFKYAEKRFWRVSFQLGWGRGVFVKN

SEQ ID NO: 6836 - protein, 103 aa, Lactobacillus casei
MGARRIRQKLSGVLLVEHLAALGVVLIAASWLTLLIRTYQRVVIPARQETTAYYAARIALVRLPSPGGRTEVKVGPDVWQVELREKGVRVHDNKKGKTFSFTP

SEQ ID NO: 6837 - protein, 156 aa, Lactobacillus casei
MTTRKGRLSHLPLEAFSLVEVVIGLGLMMVVLLLWRPLLTGIQRFTQQDQYLIQALQAEQDLQADVYAHKMKQLELKDNRVRLQGQDGAETKIYAYEFYAKRGKEGIIRSRTNDDGHVPLFMQVKSAKFQAAPQGFLYTLRLKSAQPFEGGVFLEP

SEQ ID NO: 6838 - protein, 104 aa, Lactobacillus casei
MKLRGSVFVNTLILFAVFLTLTVGLFEQFKLWQQRYQVIAKVEKAQFEAAYSRWRQQGEVTSQAAEEALATQTVPWSDTTEPNTSTNEASQPSEIKASKAEMLE

SEQ ID NO: 6839 - protein, 337 aa, Lactobacillus casei
LANEHLEKLYHVLDDSTTILNQQLKTSFIAAITEAGEDLDSGEVMQEDGLPNDEAKKKLTALFDQIKLATYEPEEIRQALQLVLVKAIKVDGIEPNKQITPDAMASLATFMVTIFIQQHPDQLRVADLAVGTGNLLFAVMNQLHKAWNVEVKGFGVDNDEALLAVAGMSSSLQHLDVDLFHQDALDNLLFKDADVVVSDLPVGYYPVDERAKKFATVTKKGHSYAHHLLIEQSMNVLKPGGLGMFYVPSQVFRSKEAEGLTKWLAKAMYFQGLLNLPDDFFADKNAEKSLLILQKPSPDVKRAKQVLLGQFPDLNDRDAFAAFIAKVKDWAAANIVL

SEQ ID NO: 6840 - protein, 152 aa, Lactobacillus casei
MSLLSIAYVLIAIVSVGVTIFDIVHVRIRATPKVWRIILYLAIAAFSLVLTLQQSRHFDDLVSGGFIVVMFLCFASWQKGLADPAIIGGLGSIRMYQNLSGLVLQAQGTGTLLLAQMGQVTVLRLHFRQAPQTLQSFLADKMAPEQIKIVDH

SEQ ID NO: 6841 - protein, 453 aa, Lactobacillus casei
MQAEKDDQPELARNLKSRHVQLIAIGGTIGTGLFLGSGQSIHSAGPSILFAYLITGGICFLLMRALGELLMSDVDSHTFIDFITKYLGKDAGWVTGWTYWICWVALAMAEVTAIGLYIKFWLPDVPQWLPGLIALAVLLLLNLVSVGLFGEAEFWFALIKIVAIIGLIVLGIFMMIVRFKTPLGHASLANLVNDGGLFPKGFGGFLMSLQMVVFSFVGIEMVGLTASETKDPHKVIPEAINEIPMRILLFYVGALFVIMCIYPWRHVSPVNSPFVEVFNNVGIPFAADIINFVVLTAAASACNSSIFSTGRLLFSLTVTGKSQSAQWAAKLSRRQVPARAILISTAVIAVAVVLNLFLPGAVFTLVSSMATISFLFVWAMIMLAHLRYKKLYPHKEGFRMPFYPVSDYLVLGFLLLTAIIMLFDRAMLSALIFAVVWIATLFILRRLRRAAKA

SEQ ID NO: 6842 - protein, 254 aa, Lactobacillus casei
MAKVLTYRRLTDDVVAAPNQNSAIPADYRWQPTRGFRLKADLVYGGSWLFAQGYCRIKLHVRNRQAFRQAAGRGYFVYGNHTQPFGDVFTPMRVNQSRRVFTLASAANLSVPVLGRLVPYGGGVLVPRRLHQLRDFNAEIRQLIQAKHVVMIYPEAHVWPYYTGIRPFETGAFHYPVELDAPVFVTTMTYQKRHWRRKPRRILYVDGPFWPDRQLPIKLRQQKLAQQVKKVMTNRATLSNTEYIRYQQEGRARP

SEQ ID NO: 6843 - protein, 279 aa, Lactobacillus casei
VTTNILFCGDASMTDGVLIATLSLMRQTRHPLHIFILTATLTVKGHHYQPFAAETAERMAKLMQAQNPEHQLTRIDITEQFLANPPLANMGTMFTPYCMLRLYADLVPELPDRVLYLDTDVVCRRPFDAFYNQSMTGVDIAGVLDHYGKWWFHHRLAWFDYLNSGVLLMNLAHIREDGLLVRCRRLVRHRWLFMPDQSALNIKAKFKRILPQKYNEQHQLKPDTVFQHFTTFFRFWPYFRIVTVKPWQIQAVHQQLGLHEYDDLLKDYRHLAPKLKEVS

SEQ ID NO: 6844 - protein, 318 aa, Lactobacillus casei
MTNTTTVPIFFSVDDGYVPCLAVALTSIRANKNPQVDFEINILNSGLLAENQKRLAALAAPHFKIRFIAMDAVTKQISGDTNKLRGDYVTLTIYFRLFIADMFPQYDKAIYIDADTVADGDLTTLFATNMGDHLFAGVADPVMMTYPETIEYIQRDFGVQPGEYINSGVLLMNLAQLRKEHFSSRFLHLLKTYHFTMIAADQDYINVIAQHRIKYLPKIWNMQTGVPTAAEPGGKLIHYNLFGKPWHYQNAKLGDRFWHYAPASGFENDLKQQLAAFTPADQQADRDSMAGMLKTAVQACHTNNTILNAVKHGEQVAL

SEQ ID NO: 6845 - protein, 290 aa, Lactobacillus casei
MKSGKFVGPDRAAVIENIRRAVTAKTFNVKVEQHDPTFSEAEETAIINRYLHQRQAWSFRLKTLICRLMVNAYALRVTKDVDVVGIDKIRSIKSGGVITSNHFSPFENMAVRKAVRLAGRHRMYIVSQDTNLAMKGLLGFVMNYDDTIPLSGRPSFLNGPFMQMLTAAFNGHHWVLIYPEQEMWFNYRKPRPPKRGAYFYAASGNVPIISCFTEIRDLPARENQQLREVRYILHVLDPIYPDPKLSVRDNSFQMMQRDYQQKCRAYEAAYHRKLTYAFSSQDIAGWDPQK

SEQ ID NO: 6846 - protein, 764 aa, Lactobacillus casei
LIDVIHDHAFHLYNQKISYLCSLLPNGQLGHLYFGPRLSLTNTDLDYLSQGSSPYAWMANFSSDQPFALGDAQQEYPVYGTGDFRQGSLSVTQDDAPVYPNFVFKDYHISHTKMRDLHHPTSFGNPALTDVLTIHLEDETAQLLLTLQYTIFSDSATVVRAATLTNQGSEPVMIQRMLSGVLNLPQGRFDVVHLSGNWAKERHIQTQPLTQGTFSVESLRGASSHEQNPFVALHAVNRSFTSGDTYGANLIYSSNFLDSIEVNEWDQTRLLIGIHPASFSWRLDPKTSFTTPEAVFSFSSGGLAGLAQVNQRFVARHIIDPQWRQKTRPVVLNSWEATYFDLNEQKLLRLAKLGRQVGVDCFVLDDGWFGTRDNDLSSLGDWFTNKHKFPDGLGHFAQEIHNLGLQFGLWFEPEMVSPRSQFFQKHPNWVVRPKRGRFSITRNQYVLDFSNPAVVNNIFDQMQKVIIETHLDYVKWDLNRSITEAYSPYLAKIGHPQGEFFHRYVQGVYTLYQKLLTAFPQLLIEGCAGGGGRFDLGILFYSPQIWTSDDSDAIERLAIQSGTALAYPLSCMSNHVTAVPNEQVGRTTPLATRFRVAAFGILGYELDLTKLSPKELATIKDQISYYHDLQPLVLNGDFSLLLPRQSNGQNQVAWLLSDHARKRLVLGFFRVLADADSRTVQYMKIPLAQPNRRYWVNGHTGPISGDVLQRVGVRLPIQFNGANREQAQLIGDYQSALLTFDGVTDIKAINRRREEEGKEKVSHA

SEQ ID NO: 6847 - protein, 41 aa, Lactobacillus casei
MKKIEHRPIAIVTIIAGSLGVVASGMSLVSGILLLTKRRQS

SEQ ID NO: 6848 - protein, 102 aa, Lactobacillus casei
MNHEVTTLISILESAGFSHDELAGTIAELNDAVNNGQATSIQLVSPGAAARYIKRINDETIFQARFRHSDEPDLLNNESNDERIENPNQDSCIVISYDPTQH

SEQ ID NO: 6849 - protein, 131 aa, Lactobacillus casei
MILLVAGCMQLLMGILLVLFRPRHQTNFWGYTSYLASVNADSFRLAQRWFCQALIVTGALEGAAGWIIHRLSWDNFFIIWLFVAVLLFLPGFVYTESRLRQYLEAHHQLPYDYVAPDDVPKPKRRKGFKDL

SEQ ID NO: 6850 - protein, 243 aa, Lactobacillus casei
VKLLMIEDNTSVAEMMAMFFQKEKWEVVNAYDGEEGLAKFKEAPDSFDIITLDLNLPKMDGMQVAKEIRQISETVPLIMLTARDTESDQVLGLELGADDYVTKPFSPITLIARIKALHRRAEVGAEVGAEQAAPEEKKDGFDVETDHFKLSTKTREAYLNGKQIEGLTPKEFDLLHTLSKSPKQVFSREQLLQLVWDYEYYGDERTVDAHIKKLRQKIEKVGPQIIQTVWGVGYKFDDSGLDQ

SEQ ID NO: 6851 - protein, 515 aa, Lactobacillus casei
MKMLYQQLIGFFAVIMVTLVIVSILFIRSTTNTVWENGFKQLEQYTDVLKNNAVDENTYVINARFIQNAEEILSDQHVHFVIYDANNVAKYPVSQKSPMAAIKSSYWKKLKQGSAVAVPELMTNPVSGRSQNMTIYYQPVFLSEKLLFVIAAFAPVEQIQSSINKTEHNLLIAFVLSTLAAFIISYFIVSYQVRRINQLRQATHQVAEGNYDVTVKMKSRSHDEVAELADDFRDMVTSLKASQQEIQRQEDRRRQFMADAAHEMRTPLTTINGLLEGLAYDAIPEESKGKSIELMRNETNRLIRLVNENLDYEKIRTNQILLSKHTFNARKDLDNIAEQLAQKAEEAGDKITIEAPEKLPTYADHDRFVQIMFNIVQNAVQFTQNGQITINGKLGYHQTEFRVSDTGIGMSKDQMKNIWERYYKADPSRKNTKYGESGLGMAIVHQLMGLHGGTIDVDSELGSGTTFTLIFPDEETAPKQKKQIGSKPSGDSAATKPDSTANTTSGSDQQTKPNK

SEQ ID NO: 6852 - protein, 177 aa, Lactobacillus casei
MTIRRIQQNDFAEVDALLQTAFSGSKRGYHGEAALVAELRRTADYDAALEVVATIDGHLVGYGLMTAVTITPDAHMQGVALAPLAVAPDYQGSGLGMAIVSELDMRATDLRRDFVSVIGDRQFFGRIGFRKAANYRLEPPFPIVAEDHLIKELVPGVLASVRGKVNYAHPFLAETLE

SEQ ID NO: 6853 - protein, 68 aa, Lactobacillus casei
MKMRQPYHLSWQLLTVAIIIAFIAFVEYWPHLSDDALMGSGLISGGLCIGALHMAHHVTDTSKSHKKK

SEQ ID NO: 6854 - protein, 159 aa, Lactobacillus casei
VRSAYWQSVHFGGIRVKQFYIVDSSILPDVVGKVIAARALLQNGEVKQVSEAVKRVGISRGTYYKYKDYVFLPDHEMASRKAVISLMLHHDRGILSEVLTVMSQAQASIVTINQNIPIHNWASVVISFDISALQGTLDDLATKLGGIRGVSDVHLISIE

SEQ ID NO: 6855 - protein, 167 aa, Lactobacillus casei
MKIAIKLLLWVLVAGVALFPALLLILFVIGLSVVISGAMAVSAVGFVLGIIFVALVGLSIMIPSVLLIIRFMTFRTVNARFRHGNQRVVLPVSVRLTGRSIYHAIYENFKAGRRQGKHLVQAWSFGFETYFHEDLQAYLADQILAQHGPEMAEAFVLDERHSYTIAY

SEQ ID NO: 6856 - protein, 111 aa, Lactobacillus casei
MAAIAMTKDLKIIMERLTPLFKRKRNTRYWISLVNQTYTPAFNFFFNIQPKDQRQRSIPLHSLHGYDLAQLEAFLGLLRKQTQLTIEFVGFEDMRWPQTNRVIQRRARLDE

SEQ ID NO: 6857 - protein, 435 aa, Lactobacillus casei
MAYDYPHEPHRVIFLIDNKSFYASVESIERGLDPLKTILVVMSEQENTNGGLILATSPMAKKMYGLKNNVSRQRDLPNEPHLIVVPPRMNLYIQKNLAINDIFRQFVADEDLWAYSIDESILDMTHTWRLFGKTPEAVAKLIQSTVQQQLGLRTTVGIGENPVQAKIALDVYAKHSPDLLGEIKYATVPNTIWKINEMTDVWSIGHRTAAHLARMGITNMYELAHANPYALKQEMGIIGTQLFATAWGVDRTKISKRIVTRQPSIGNSQVLPRDYSNQFEIEIVIKEIGEQVAARLRHHHKRAGELSLGIGFSYAESQQDGRSGFTQAKRILPTNRNTDIVAALREIFRKNWHGEVIRNVAVFTSRLAPDTGEQLNFFEPVDRQIKATDLERTLDTIRSRFGFKALVYAKSAMHGGTAIQRASLVGGHNGGNSYD

SEQ ID NO: 6858 - protein, 56 aa, Lactobacillus casei
MTSDKWRPLVVTLIVIAAIFAALFILEVFNNGGGMGIAHGSMMRSISSWHMGGCMR

SEQ ID NO: 6859 - protein, 403 aa, Lactobacillus casei
MQASLKFCPNCGQPIGPDDDFCPNCGFDLRAARQQAQSTNQKEAANSQSSPATPSSTASSTTATAERRRPPRSPRRWLLITGIAVILILGIAYFAGATYYSQDRQVTELAEEMTSGDADDMAEVAVASDGTALHEDDLKPLAQLIKNRSDRSLLHSMIMAKSTSGTVQIVKAGHELLIFPKYKVKLGTADAVVKTNLKNATLTLNGTPAQAKAHDGQYIITGQLPGVYTLKLSGTHDGTTKDFTREVVIPLKGQASDLTLDAATASSSSATSSSSASSQNSHPDSNTHDDDSDDDYDDNGVTKTTRQYPSDPSKRNDNHSTSGIVGRWESGDQATFTFNSDGTYTATNNGTPSNGKWEVVYRDGNVFNIKFTKSDGGSTVEPFVLDDDDLIETNLKIKWERDD

SEQ ID NO: 6860 - protein, 262 aa, Lactobacillus casei
MKKVWVGLGLLLLLLAAGCGVQRHAAKSSRASTSASSRQVSASQKASSVPQTPLAKLKDRSKDTLVYAPFGDSLSVGLFADKKASRFTSLFAQQLGQLTGKTVTEAGIAEVGKTATNLGVPALSSLVAQQPDVVTIEFGTNDAVGGATPSALAAYRQALTTIVTTLQEKTTAQLILMTTWSPNNGPYAAADLKFDAVVKEIGRSYHVPVADLATIWQGHDDVTGPAGTAIPDFAANGPRDTFHPNQKGHDQIAALLIKTLEE

SEQ ID NO: 6861 - protein, 750 aa, Lactobacillus casei
MVMDAALKGMNDKQTEAVLATEGPVLIMAGAGSGKTRVLTHRIAYLVEEKNVNPWNILAITFTNKAAREMRERVGKLVDPEIARDIWVSTFHALCVRILRRDIDKLGYNRAFTIADPAEQLTLVKHILADFNLDPKRYDPKSILGAISNAKNDLIDPQTYADEQANSPFTKIVAEVYAEYQKRLRSDQALDFDDLIMQTIVLFEKDKETLAFYQRKFRYIHVDEYQDTNEAQYRLVHMLAEGYHNLCVVGDADQSIYGWRGANMQNILDFKKDFPKARVILLEQNYRSTKTILSAANDVIKNNLNRQVKTLWTENSKGDKITYYRAQSETDEAIFVIRRIEEEMAEHHRHYGDFAILYRTNAQSRAIEEAFVKSNIPYKMVGGHKFYDRKEIRDALAYFRLVVNPEDDMSFTRIVNEPKRGIGNTSVEKLEAFASQHGWSLLEAAGNAELSPISGKARGNLAKFGKMIQELGTRRKDLNVTDMMQAILDESGYLDALRAAHTLEADTRIENLEELLSVTQGFDERYQPENEDSDIFVDFLAELALLSDQDEVEEDAQEVTLMTLHAAKGLEFPVVFLVGMEEGLFPLSRAAMDEGELEEERRLAYVGITRAKQKLYLSNAYARMLYGQRQNNPASRFIEEIDPDLLEVVGGNQPKSDIPFINRTDRAFSSPYSRHAETAATPVTVKPVPTTGAGKTSWEAGDKVTHRKWGTGTVVKVTGTGDDQELDIAFKAMGIKRLLAAFAPIKKIES

SEQ ID NO: 6862 - protein, 674 aa, Lactobacillus casei
VLTKPAAQFTLEEAEAEVAKLRKQLNQWRLEYYTKDAPTVTDNVYDDHYRDLQALEAAFPKLVTPDSPTQQVGDVINSDFAKVQHPIPMLSMGDVFSFEELSEWDARMQANVGHPVNYNVELKIDGLALSLIYEDGKLVQGSTRGDGNIGEDVTKNVLTIDSVPKTLKKPLSLEVRGECYMPKAAFAKLNARQETEGNPPFANPRNAAAGSLRQLNPRVTAGRELDTFIYTLIDPDRFNVKTQHEAIAFMHDLGFTTNPSSEVASDMQAIDAYITKYTSDRDALPYGIDGIVLKVNDLALQAQLGNTVKVPRWEIAYKFPPEEAETVIHEIVWTVGRTGVVTPTAVMDPVQLAGTTVSRATLHNADMIHDKDIRIGDTVMLHKAGDIIPEVSRVLVAKRPANTPPTPIPEKCPSCGQRLVHLDDEVALRCINPMCPAQMQEQLTHFASRNAMNIDGLGPKIIAQLQAKHLVRDVADLYRLTATDLAQLDKFKEKSINNLLSAIHNSRQNSVERLIFGLGIRHVGGKAARILAEHFGDLDHLMAASQEDIAEIPNIGPTIAEAVVTYFKTDTVRKLIDQLRSAGVNLRYTGPTQSAVKDSFVSGKTVVITGKFAEFSRPDLTKQLEKLGAKVTGSVSKKTDLVIVGEAAGSKLTKAQKLNVPTMDETELLANLKN

SEQ ID NO: 6863 - protein, 383 aa, Lactobacillus casei
MKKFLTLTLLTGAIMLLAACGKLNLDSNSSSTGGTKTGSYQTTGTVDNSMYQGVIKNGRYQTSSARGLTLQQNDQGDNTFNIKSMESGLQTLAKNQFPTDKYSFEEGQLLSTATARSWLKRESKSNAEGLNPPDNGKKDPDTRNPIYLQQILEQDFMLQDGNSMKLGGIAIALGMNKVDYYTKTEYGAQYQTEISDETIKKQGEAIAAKVVARLRKMEKVPDDIPIVVGIYKNAEQDSLVGGVYVEHATSKNGTDIGSWKKLNQQNEVLPVVGDHKAINSTVSNDFSSFTNQVKGFFPTLAGITAQAHYEDGNLAGLNITVNTQFYGLTEIQSFTQYISTAASKYLPSGVPIEITIQSTQGIQAFVSRSSGDKGFYTHVFGSY

SEQ ID NO: 6864 - protein, 98 aa, Lactobacillus casei
MISKDSVAHVAGLAKLQFSEADLEKYTDQLAEILDMVEQLEQVSTKDVPVTTQSIHLENVMRPDVAKPAEPVAELLKNVPTKKGTLIQVPAIIDKEDD

SEQ ID NO: 6865 - protein, 484 aa, Lactobacillus casei
VDYFKTSLDQLHEQLRTGKLTSQQLVDETLAGIDKIDPDVAAFLAINADGAKKQAAAVDAAGIDAGQPLSGVPIAIKDNIVTKGVVTTAASKILANFNPIYNATVVEKLAAAGAINVGKTNLDEFAMGSSTENSAFKTTKNAWDYTRVPGGSSGGSAAAVAAGEVVAALGSDTGGSIRQPAAFNGIVGFKPTYGRVSRWGLIAFSSSLDQIGTLTRNVKDAAQVLNVIAGHDERDSTTADTPVPDYTEKIGQAIKGMKIALPKEYLGKGVDPAVADKIKAAAKQLEDLGATVTEVSLPHTQYAVPAYYIIASSEASSNLQRFDGIRYGFRAKDVHNIEDVYVRSRSEGFGPEVKRRIMLGTFSLSAGFYDAYFKKAGQVRTLITRDFEKVFNDYDLIIGPTTPTVAFKIGEKVTDPVTMYMNDILTIPVNLAGLPAASVPAGFVDGMPVGLQLIGKPFAESTIFQVAAAFEAQNDYLAQIPGGK

SEQ ID NO: 6866 - protein, 476 aa, Lactobacillus casei
MNFETTIGLEVHVELKTKSKMFSPAPVTYGQEPNTETNVIDWGFPGVLPSINRGAYQLGIMVALALHADVTRETHFDRKNYFYPDNPKAYQITQSEKPLGTNGWVEIEVNGKKKKVGIAELHVEEDAGKNQHEDDGYSYVDLNRQGTPLVEIVSKPDITSPEEAYAYLETLRQIVQFTGASDVKMEEGSMRVDTNLSIRPIGQKHLGTKTEIKNLNSFVHVRDGLAFEEKRQQSVLLSGGEVRQETRRWDPDAKETILMRVKEGADDYRYFPEPDLPPVTVSQQWIDEVQASLPQPPAERREHYIQDWGIPAYDAGVLTQTKEMSDFFEATVAQGADAKQASNWLMGEVSGYLNAKHMELGQVALTPEHLAGMIKLIGDGTISSKMAKKVFKEIIQHDTDPDHWVREKGLIQLSDPAKLTPIITAVLDDNQQSIDDFKAGKDRAIGFLVGQIMKQTHGQANPKVVNQILMAEIKKR

SEQ ID NO: 6867 - protein, 341 aa, Lactobacillus casei
MRKRARLIYNPTSGNEGLKRFVPDILDIMEQAGYESSTFQTTPKPFSAREEAKRATEAGFELIVAAGGDGTINEVVNGIAPAKKRPKMAIIPAGTTNDYARALRISRDNPVEAARVILKGQTLAMDIGQANHHYFMNIAAGGLLSELTYSVPSEVKSIFGYFAYVIKGAEMLPAVRTMPMKLEYDGGVYEGPASMFFLGLTNSVGGFEQIVPDAALGDGKFSLIIVKTANMANLLKLMALVFNGGRHVDDPNIVYTKTRKLKVKTGGNETLKINLDGEYGGDAPMTFVNLKQHIAMYANLDEIPTKNLGTDAQKQKDYMAEVESISHRDIDGDGQIGSQDE

SEQ ID NO: 6868 - protein, 453 aa, Lactobacillus casei
LAQPAVTKNQDLEVTIQDLTYEGMGVAKVAGFPLFIEDALPGEKMQVHVLKVQKQYGFAKVVKRLTDSPDRVAGADGAYIRTGIAPLSILAYPAQLKFKQRQIEELYKKAHLAIDVLPTIGMKHPLGYRNKAQVPVRMANDELQTGFYKKHSHDLVPIEDFLIQDPKIDHAIVVVRDLLRKYKVPAYDERTNRGVIRNIMVRRGHATHQMMIVLVSRTWQVPHLKDIVEEITLALPEVTSVVVNLNDKRNNVILGRKSKTIYGQDYLLDKLLGSEFQISPVSFYQVNPVQTEVLYTQAIEAAGLTGKETVIDAYSGIGTISLTMARHAKHVYGVEVVESAVRDAQANAARNHIKNVTFEVGKAEDVIQKWKDADLPVDVLMVDPPRKGLDKSFIDAVGYMKPPKIVYVSCNPATLARDLQLLAEFGYTAKQTQPVDMFPQTQHIESITALTLD

SEQ ID NO: 6869 - protein, 683 aa, Lactobacillus casei
MKKFGKRVASILGCGVLLLGSIGLSSSASVAHAAGDQPISDAELNQYISKMSLDEKIGQMFVSRTPQDTAQARADVAKYHLGGLIVYGADFTSVEGSTPEAAQTAFKNKLQSFQDSAKLPLLIGVDQEGGSVSRLSQNPLIANGRAFPSPQALFAEGGMAKVTQEAQQVGTILKNLGINWNYAPVADSTADTDSFIYPRTIGQDYTATADYISQVVPAWQNTGIAATVKHFPGYGSAVDTHTDFAVVTKSEEAFEKEDLLPFKAGIDAGVDSIMIAHIVMQSVDPVYPASLSKSVVTDLLRDKLGYKGLIITDALGMGAITKFAASHNNVPVDVLAVAAGNDCIMNDDYATAIPQIHQAVTSGQLSEQAIDQHVFRILSLKRKLGLLTAVQLETKQVRVDNVAYDQAKKTATVSGTVVDSNWQTGEPLTVKDDQGHVVATADVGAGGKFNFTIPLTAKAQQLTLTTGLPGIEDAQVTIEPLQAAKVDKTALQSLVNLGAAYAANDYTSDSWGKYQVALTAANQVLTDQEATQAAVDHAAQTLQKAITELVKANVKINKDALQQLVDQVLAYDAKRYTTSSWTKLEAALAAAKQVLADKNATQPVIDHAVQVLKTAATGLETQVSGAGQQKTVAFTDKKSPNKVRGDNNVMPRAGEKVVNGLVILGVVLILTTAGMIWWRKARD

SEQ ID NO: 6870 - protein, 36 aa, Lactobacillus casei
MVCPKILDNKFPAVPNSAISGQMRAGDREARGVGTT

SEQ ID NO: 6871 - protein, 407 aa, Lactobacillus casei
MKWGSIVQHKTLAMKWLFLGSLITNTGISLIWPLTTIYMHEYLGESLTVAGIVLFLNSMFMVVGNSLGGWLFDHWQPYGTILAGIGLNLGATALLIFFHGWPAYPLLLVISGLGSGVTATAINSYATRIRDKRPSVVFNVLYFTSNLGLVIGTLIVGFVLPYGIAMVFALAAGLFAIFLVVALWHYRIEKVTITASAKQVTQEGRNPARPRLVMLMVTLFVTWLMYEQWQSNISAFMLSEGLTIKDYSFLWTINALLIVLFQPILTAFDRWLLKHIRLRLVVGFILFAGSFLILLNGSGAYLTFIIAMIVLTVGEVLALPAVSTYVTLFTPLVQQGRYQGLIQGFASAGRALGPLLGAMIIEGTSSYRLLFVSATGLILLAALGFALTVRESIPALNDPLHPAAHSR

SEQ ID NO: 6872 - protein, 270 aa, Lactobacillus casei
LRYRLILSDIDGTLLNSQHQLTAGVKQAIQAYVAAGGIFVLASARPPLAMTALARQMGLAVPLVSLNGALIGRPEGEQFRILAATSWPEGVGPRVYHALSTLPLSLNVFSGTHWYVAAFDKWTDQEAAITDIMPTTAPIRDMLRDNLSVQKMLCMGDPSMVDRAEKIILAHPEWQLVASRSKATYLEIVRQGVSKKSALQTLSSLYNVPIQETMALGDGENDLPMLQAAGLGVTLANALPQVSAVIKTVVPDNDHDGAAVAIQRYAMGET

SEQ ID NO: 6873 - protein, 291 aa, Lactobacillus casei
MTLEKYRFDGTGTFDIKAFATAPPDEFKNKKDKIKEDIEHNIKTLSKVQEHLAAQKQYSVLIIFQGMDAAGKDSMIEHVMSGINPQGTTVVSFKVPTELELSHDFLWRIHNAFPAGGELTVFNRSQYEEVLVDRVHPELLLKENLPGIDSVSDVHDELWTERFNDIKALESYARRNGILLLKFFLHISKAEQKDRFLKRIEIPEKNWKFSLADIRERRYWDDYQKAYQEAIQHTATKKNPWYIIPSDDKWYSRLAVSQIINREVTALPLKYPVISEAQKQGLVQAVADLRD

SEQ ID NO: 6874 - protein, 634 aa, Lactobacillus casei
MALPRIQDDLYMAINGAWQEKTQIPPDKSVVSADSDLSDEIRTKLVADLRKMALTGSDTVSPLRYAARLFAKADDKAKRQQLGIDPVRTRVQTLVKLKTLDQFRAAMPTLIAAQYVLPVTSYVDADMHDAEHNILNLSGPDTILPDAAMYRNGDAENAADLAAWSKMATAMLAAAGFSESDQKDYVEAAKRFDRRLAADVPDNVDLAVDSTFDNPMTWQAFEEAAGFLGIPQAFADLMPQTPTKVNAVVPNYVPNLPTLITADNYPEWHAWMVINELLSCATYLSDDLRQLAGQYDRFLAGQPEPSSWTKHAFGIANEYFDDVIGQYYGQTYFGADAKADITAIVEQILAQYRVQLENNTWLSSMTKQKAIRKLATMKVKMGYPDQLFSLYDHLTVDADDDLLTAILKLSSQTQQFWFKQVGQPVDRNEWNMPGHLVNASYDPLKNDITFPAGILQPPYYALNWTKAQNLGGTGVTIGHEISHSFDNNGALYDEHGNLHNWWTTADKKAFDQLVEAMVAQFDGRAYEGVKVNGKLTVSENMADNAGMDVALALLGEHPDAKDLQAFFTTYARSWATKMRPERVKTLLRQDVHAPAALRVNVPVQNFPAWYQAFQVQPQDGMYRQPRKRLTIWHR

SEQ ID NO: 6875 - protein, 151 aa, Lactobacillus casei
MATRRAMPKDIPHLLPLIQGYYHDSPVPLTIDSPAMAAHLERLRNDPGLGYLLVAEHNEQLAGFAILYRSFDTRTLKPVLIINDVYVAPKFRRRGLARQLMAAAFELAADEGFASANWQTRTSNLGAQHLYDQIGERETGWLHYHHVIHDA

SEQ ID NO: 6876 - protein, 290 aa, Lactobacillus casei
MYQLLTDSCCDLPYQTLHDHHVDFVSMHFTIDGVEYEDDLGEDHYDINAFYQQLKQNVMPTTTQVNVGQFVDFFTPYVKAKTPILYIGFSSGLSGTFNSATQARAMLLEKYPDAQIYLVDTLAACAGEGQFVLDAIDKRDAGMPIDELAKWLNDHRLDYRMWFTVDKLDFLYHGGRVSRTSAALGTMLNIKPVMDVDTEGKLRVVRKVRARKRSLIDLANETLKAVQENPQHRVIISTSGDREAANFIKDRLHEASPQTPLQIGNIGPTIASHTGFGCVAVFSMATEDRQ

SEQ ID NO: 6877 - protein, 310 aa, Lactobacillus casei
MNVVLISIAVIVLVIVIAVLFTSVAIIHTGEVGIVERLGKYVATLQPGFHVVPPFIYRITEIVNMKQIPLKVDEQEVITKDNVVVRISETLKYHITDVNAYVYQNKDSVLSMVQDTRANLRGIIGNMDLNDVLNGTETINQTLFQQIAETTAGYGLNVDRVNIDSIQVDATIQDSMNKLLRASREKEANIMEAEGHKQAAIAKAEGEKQAAILEAEANKQTQILQAQGHAESQRLIAAAVKDQINSINAGLIDNGDLYLKYKNVEAIEALAKGTANTVVLPSTAIDSLGTLPALGKLFNQTSDAKDTKEN

SEQ ID NO: 6878 - protein, 64 aa, Lactobacillus casei
MLDDRLLGTTFILPTSARQGEITLYGIHYHYRVNDDAAAGDLVVVNAVSPLFLGVVKPEHRLKY

SEQ ID NO: 6879 - protein, 241 aa, Lactobacillus casei
LRSRRVIYADTYRHRWHRWLFVAGGILVVLLLVGWWLQRNPRPDPSTYPILGVRLDQTDGVQDFDRLRASKVSFVYLKATEGSSYFDDNFNTNFNQAAGSRLSIGVYHVFSFETTPQAQALQFERKVGSNIGDLPIGIYLSYYREQKPSAAWLTQHLNAFITTIQQQYHRPVLLMGSPDILAKVKTVVPQAPRWFVSDKQPAQKGNFWQYTAGARIPNGPQATYRAAVFMGKRSSFLRLAQ

SEQ ID NO: 6880 - protein, 118 aa, Lactobacillus casei
MKKVLIGLVVLVVLVFGGLKIFEITNYGGTTYYTKITNTGQRVTNRDNEGNKHTIYAYDLPGFDERGGLQQLKFNANRDRPLRKNAFLKVTYNDKKGVTSWESISRSQVPKAALAKLE

SEQ ID NO: 6881 - protein, 118 aa, Lactobacillus casei
MASFLRGLKYALAHRGHHHKDKGKAPNPAMALAKNFTGSFAFLDEQTNKTHSLAISPQLQIAIDNKILPGQVVGITINELTFLDHYGYKLVITADDNGPQTIYDEAEDATYAIIIPSA

SEQ ID NO: 6882 - protein, 317 aa, Lactobacillus casei
MLKLGVIGTGWITKQFVAAAKATNAFELTAVYSRHEESAQSFIDQTAPATAYTKMDDFLGSDVDVVYIASPNSLHASQALAALDADKHVIVEKPLVATAMEFEKLDEALRKKPQLYLFEAARHVYEHNFQVVNDFTHRQQIDGATLTYMKYSSKYDAFLAGKLPNVFNPEFAGGALMDLGIYLVYDAVAWFGVPDNAVYLPHFLKSGVDGDGVARLDYGDFSVTLITGKTTNSSLPSEIYSGRQTLTMDNAAELETIKLDDQVLSTEKLDNPMEAEAAYFAKAITGQDRNAFDKAWQLAKEVHQVMSILRTSANLDF

SEQ ID NO: 6883 - protein, 467 aa, Lactobacillus casei
  misc_feature (6)..(6): Xaa can be any naturally occurring amino acid
DEADBXATPDEPENDENTRNAHELICASECSHALTIATPFQKRWQADGFTEQTPIQAAVYQPLKTDEDVIGLAPTGSGKTLAFGLPLLEKIVPGDGLQLLILAPSQELAIQTRNVLTPYAQDIHVNVQGIIGSANVKRQLTRLKEKPEVIVATAGRLLELIQSRKLKLAGLQTLVVDEADEMLRDPGFAQVREITAAAPAETQLAFFSATPSPYFKEMSKWFGKTPKLIDVRAIDKTQGTVRHLFLQTDRAHQIDWLRTLAHTDGFKALVFFNQNASLERAAGILRHQAVRFAVLSREGRQTSRQKALTDFRHGRVTLLLVTDMAGRGLDIPKLPAVVNFDPPKRAEVYIHRAGRTGRMGESGMVVTLGDDHDRRDLAKLVPQYGIHRAYMVDGKLVDTPPTPSADTPKDSATVDSAAQVPKQKPARKMPKKEQSAKAVDPGEKPHRKHKKNRVRDRRNKGKHKKQP

SEQ ID NO: 6884 - protein, 109 aa, Lactobacillus casei
MESMKAEQMAAMMTLMSAAGDAQKATMAAIDAAKADQIERSRKLLKHADAKLKQAHQAQTQMLTYEARGQKVDVTLLMVHSQDHLMSAMTIRRLADEIIDLYQQVHAQK

SEQ ID NO: 6885 - protein, 140 aa, Lactobacillus casei
MKIEKTLQTPAAFLYSKIVAPVQADIIAAGHQPVDMAKLGGFTYRKQFPDGEWAQVKVTQNVINREFAMLTMTRFSRFKVRYLITPLSAAASRVQVSETVQPINWVAQLKQMVTELLVGHKRRRNVGRMLDSIERSYRTA

SEQ ID NO: 6886 - protein, 438 aa, Lactobacillus casei
MSYLPLSKFKYNNNGTGRKSPQEIDAEYRLRLSGPSTVTTTLFPVLENPALLDLAAAENKAISVAKYPIFFVETHDINLLVSRIQSHSATIVNLANHQQFPPVAIRSYLKKLLSNEIIFTNEIEGVQTNPKEIGTIIGNLQQKPGRVEKRLESTIRKYHDSATGRMRQINGLKDYRDIYDELLKGEIPDAKLPDGKLFRNKFAFIGTDAHAVHIPPVTENEIEVALEQLIIFMNSDDLLTLEKAVITHFMFENTHPFLDGNGRTGRYLLSSYLSSKLDPFTGLSVSTAIHNNLSTYYRLFQEADNIENRAELTFFLKGMLKIIESGQTDVINELESSKEQLQSTSKKLYAKFTDLDDVMKEVLYVLLQSYLFTESITYGIQDRDIVEVLKRTPNSIPRTRTKRAIDMLESKKMITSVSKNPLQHVISKEVLAEILPSK

SEQ ID NO: 6887 - protein, 240 aa, Lactobacillus casei
MQAFMNVYVPGWLIFIGGILLISVVNGATVQAMVNHAGRSNTQIWYMKPGIFVHELLHAAIARVFGLQVTNFSLRADPLQGSAAHVSLRYDRHDPLAQLGLFLSSSAPVWGISIVLLVLGRWAFFPAGNQVWQVLAASSSLSEKWVMMRGMVAINWQWLAIFLVVTLILTPGVALSHRDLQNMWQSAPVAFLGTMVIFYLFLTFWPAGFSWWTLLNLNLLLLDLMVLGFSLVIWFVVNLL

SEQ ID NO: 6888 - protein, 595 aa, Lactobacillus casei
MVVTQPTTILKEKFGYDHFRTGQKQAIDRVMAGESTLVVMPTGGGKSLCYQVPAMLLPGLTLVVSPLIALMKDQVDALNDNDIPATFINSTLDFQTINERLNQAKSGQIKLLYVAPERFDNDWFVQQLAATHVALFAIDEAHCISQWGHDFRPSYLNLAQVAAQLPEHPPVIALTATATPRVSQDICQRLMIPDDGVINTGFERDNLSFKVVRDQDEDRYLLDYLKLNVDQSGIIYASTRKEVDRLYTFLEHKKLPVAKYHAGMTEKQRAANQEDFLFDRKPIMIATNAFGMGIDKSNVRFVIHAQIPKDLESYYQEAGRAGRDGLPSEAILLFKPQDLQVQRFFIDQSEGDEAHKQRQYDKLKTMERYANTDQCLQQFILDYFGQTGTKPCGRCSNCLDDRESVDVTIDAQKVLSCVVRLHERFGKGVVAQVLAGAHNQRVLSFHLDQLSTYGLMQNRRQRDITTFIDFLTAGGYLETRGGQYPTLGLTAKGAEVLRGRATVFQKTAQKAKQTLEVDDTVFQELRSTRRQLAEQQHLPPYMIFSDKTLKAIGSAMPQTMDEFLAVKGVGQAKLDKYGQIFLDVLKAIQPEKAQS

SEQ ID NO: 6889 - protein, 411 aa, Lactobacillus casei
MPLANFNEKLKQYADLAVDIGVAVKPGDTVYLQIAVDQAQLARLIVAAAYQRGAAEVQVQWSDDTLKRLDMAHMAEDRLFNIPPFVKGQFDYWVDHQAKRITVISSDPDNLAAIDPTRIAKYQKAFTKAYQRLMNAISSMSISWTIIGAASPAWAQKVFPDAKTPQEATDRLWEAIFKTTRIDQPDPEAAWKAHDQKLSAKAKWLTAEQFDQLHYMAPGTDLVVGLPKNHIWKGGGAFNPRGEEFMANMPTEEVFTAPDFRRIDGTVVSTKPLSYSGQILEGMQFTFKNGQVVKAHADRGNDVLQNLLKTPGARSLGEVSLVPDPSPISQSGLIFFNTLYDENASDHMALGQAYPFSVKDGVAMNAEQRRTTGLNQSPTHVDFMMGSASMDIDGIKPDGTVVPIFRNGDWA

SEQ ID NO: 6890 - protein, 202 aa, Lactobacillus casei
MARKKTITHDQILNAAYDLVVEQGFKSFTARNIAKKMNCSTQPIYLEFKNMAELKQAVMDRIKELLALKMAKHYTNDPVVDLGLAYIYFALENRPLYRAVFVEDHFGVDEMREYAMSTAMRVFDAYEPAKNLSEAQLRNTICGVWIVATGIANLMAPGFIDITRDQMVDILTAVTQDFIVNGRFSDDPRISWFEKAQIAQGY

SEQ ID NO: 6891 - protein, 458 aa, Lactobacillus casei
MGSSSDLKELLRERVAAKYTIDDLKETGKKIRETAPIESLAAVSKIDRDPVQFINSVEQNLTESLLPMRHQRMGASQAAFFRGTAELMAYDLRQGEKSGINLLIDGDAHLQNFGFYASPERNLLFDLNDFDEAQINSFEFDIKRLLTSVYLLGDQQGFAADKLDELVQTDASIYRKTLRDLFKLGALDRFYQSTEVNHLMQEIPGAEDSQLLAKFVKKATKRNNDSVVKKYTLTTDDGHMRFKDDPPSSVRLDQATYQAIYDGFTQYRKTARSDILVLLSQYRITDIIHHSVGIGSFGTNCYLVLLSGLGGSHLVLQVKEALPPRPELLPHTERITLQQEVSQGQRIIAAQMILQKASDPFLGWFNVGDKSFYVRQFRDMKGSVDLEELSFTEFQYYTQMTAYLLAMAHAQTPQAAVVTGYLDKHFDSAVQRWSKWYVNQVKADYAAFLRAVDSHLLA

SEQ ID NO: 6892 - protein, 333 aa, Lactobacillus casei
MARKKHRQKRPLLSAEQQDMIRSGQMALAEMKLPRRTKFWVFVRLAMNRVAESNIGQSAAAIAYYALLSLFPLILFVANALPYLGLTYSSLATYLTQAVPSNVMKWLDPVIANLLNTSSGGLLGIGAVATLWAASLGVNGLKMGFNQVYGVDATQNFIIQRLLSMLMTFMLIIVMGTILIAFAFGRQFLEWLIPLLRLNDDWLKTFNTLRWPVTVTALFIIIMFLDYFLPNVKIKIWTVLPGTAFTVIGWLLIAQAFSLYMHYFGTRYLSYGTIGTFIAIMLWLNFSSLVLLWGAVINALTAEYFIGRLHRSKGKVHDFVKRRVKTPRPKEKS

SEQ ID NO: 6893 - protein, 153 aa, Lactobacillus casei
MASARIVYASLTGNNEDIASIVEEAFEDLNVDVTTTEVSQALASDFEDVDICVTATYTYSDVGDGELPDEAVDFYEELQDLDLTGKVYGCCGSGDRFYDDFATSVDDFDKAFAKTGATKGAENVKIDLSPEEEDIKHLEAFTKQLVEKFKSMQ

SEQ ID NO: 6894 - protein, 274 aa, Lactobacillus casei
LITIKSAREIKGMAKSGAILAAMHVGLRDIIKPGISSWEIEKFAKEFFESHGAKAEQVGFEGYKYVTCVSINDEVAHAVPRKGLKLKDGDVVSVDTVISWHGYFSDSCWTYGVGKVSEADQKLMDVTKKSLYLGIDEAVVGNRIGDIGAAIQTYTEDDNGYGDVRELVGHGIQPTMHESPNVPHYGVPGHGLRLKAGMTITIEPMITEGTWKIKGKQVPGDTWEYYVTADGSKCAQYEHTLVITDNGPKILTSQGDPIDAKYQLTEDDLKTLPE

SEQ ID NO: 6895 - protein, 348 aa, Lactobacillus casei
MAAQEALISVIMPVYNAEKYLAQALDSLLAQDYSNFEIICVDDGSVDTSKIILAAYARQNARIHVVRVKNGGQARARQVGIEHAKGSFLAFMDSDDLVHPQWLSTMAEGMQTPRVDMTVVNYYNYIGGTKIKARSFHAPVFTIEGDDKYRYWLEDHDLRGYLWNKMFRADLFKEPVPVANFNLLEDAYFIGQLLPRIDQIHFVDQPRYYYRFNATSSVHAKFQKRDLEAIHQLGAVFLTLARKKPELTSLAVRRYAALSLFVLSKMSPRQLVANWGYAQQLGMVLAQYAREFQGIISAGDANALAADKPGKASLLGKLRAWSHLLGLPTFDDLNKLAGRESDEAKKES

SEQ ID NO: 6896 - protein, 77 aa, Lactobacillus casei
MKTLIFSFKSEAGKATSIRINKYDAEITADQAQQFADAVAQAQAFKKEGMNLYATPVSAKVTETNSTDLFTTEKKPA

SEQ ID NO: 6897 - protein, 69 aa, Lactobacillus casei
MSRNITSQTIVYTLTDPENEAFKQVRRMNNVDPNAKDEELLAIGQAFAKLYPNATLTSTVLQQQAAVVA

SEQ ID NO: 6898 - protein, 296 aa, Lactobacillus casei
MINRAVVFCVKGLHIMLTATAITSLIKHYKSANPMKILVIMEGGYQEDIDFIRQMPQLFGKEQVSIDFWTPPYDMMEKVSDHFETGTKLPKMVLWRLLLPYYFQAYDQLAYLDNDVLVTTDVNELFDQLTPEDILGGVLDYEDATHPNHNRAKEFFLPSTDQYINAGVFVANARAYRAFAPFDKMMAAINRRNYPYGDQNIINIVFYQHIHLLPWRFNLQYDDRLLNKYEHLAPQRVNEIRSQLDRPGIIHFASNGYFPMPWDKFTPTTRWERMWWQTFAEIKEKQLAFLDPGQQK

SEQ ID NO: 6899 - protein, 357 aa, Lactobacillus casei
VITAQAPGKLYVAGEYAVVETGFPAIIVALDQFVTVTVEAAKHFGSIVSEQYQENSLYWQRQGDEMVFDNRDNPFHYILSAIKLTEQYARELNKPLALYKLYIDSQLDAKDGKKYGLGSSAAVTVATIKALAKFYDLKMSKDQIYKLAAIAHLDVQGNGSLGDIAASVYGGWIAYRSFDKAWLAAARNQMSLADLINADWPDLSIELLTAPADMQLLVGWTGSPASTSQLVDKITLAKAKKPQLYQQFLTASRETLEKLITGFREHSLSHIQAGIRRNRELLDELAHFSGVAIQTPALRQLVTLAEEAGGAAKSSGAGGGDCGIVLIDSHQAIQPLLAAWRKHHIEPLKFKVHEIND

SEQ ID NO: 6900 - protein, 306 aa, Lactobacillus casei
MRVKVRKAVIPAAGLGTRFLPATKALAKEMLPIVDKPTIQFIVEEAKASGIEDILIVEGKQKRSIEDHFDSAPELEQNLKEKHKDALLQLVHSTTDIGVNLFFVRQPYPRGLGDAVRLAKSFVGDEPFVVMLGDDLMNDKVPLTKQLINEYDKTHASILAVKKVPHDEVSAYGVIDPEKEVSKGLFNVKKFVEKPAVADAPSDLAIIGRYLLTPEIFDILENQKPGKGNEIQLTDAIDTLNQTQRVFAHEFTGDRYDVGNKFGYVKTNIEYGLTHPEVKDELRAYILDLAAKLQSGKSVGKPANKK

SEQ ID NO: 6901 - protein, 528 aa, Lactobacillus casei
MNFFINASMPKQKSGIEHAELARFRLFNAHHVESRIVIRDWDPQLHVHAKEAGIADRQLIGMFDYFQEALDVPSKKIVTSELDFGVMNTHVQHEERRDLVFTAREQLVARVNLNNNRTVQSVELFDGFNNLFRVDHYDSRGFVSLSQWYTPDNKIGTETWQTPAGKTVLETFNKDDAVGKRQKSGWRLIDRDGTVRQFDTIERLTKHFFDLLNETFWSETTPNIFVLDRSHLGDWGLLHLKRPAYTVFYLHNSHASDSQDPMNAILNNFYEFGMHAMNGYDAVVSATHRQTRDVEARFSPQTKLFTIPVGIIPDRQLAEPRIPVAKRQFGKMVVFARIAWEKRLDDLVRAIGIVHRAIPAVSLDLYGYADPSENFKARRAIEAVIKEDHLEEVVKFKGYTTDVAEVENHAMMYGLTSRMEGFNLGIMEAISHGLIGFTYDVNYGPNEIIEDGINGRIVANGDYKALAAAILDVLRDPELAQQYSTGAYDSAKRYSETNVWQAWQALLKDAQSQWPSKLQAMPALVHNQ

SEQ ID NO: 6902 - protein, 521 aa, Lactobacillus casei
MNYFIGNDIFVMNSGTEFSQAQRVHLFKDMGLRAQYVTRNYNPLLAHNRLDLGLQAEDVLNMYDFFQGTVDVQRREQNLRLLSQIPLDEYHLIAHGPNETMINEAGREIAKIQVMPGTVGLVHSITYLDRFNNPAVRENFDWRGFKSSVDYFHPDGQLAVQKFLNLAGKTVLEVTHMNIEGNVQPTMWKLLDYKGRNFRFNLEDQLFLFFLNELTAAHPHSLLISDRRDLDYVVASVQQAGSKWAYLHDVPLRRSGKRADWLPAYQPLLEEHRADFDGLIVATVAEQKDLRARLPDLPVIVAPDTYVPRGLKPINEAKRDPHLILFVGRLSPEKRPDQAIRVLAKVHETLPDAKLEFRGYAIDQDYLEKLKDLAKKEGVREQVAFADYVTGDQLASVYEKGSVILQTSRNEGFGMNLLEAMSYGVPIVAYDTPYGASALVADGVNGYLAKNGAITDMAAKVTKILSDRKLWEQMHTAALEKRGDFSQANAETAWQKAMKDIRETVGSDRSASLTSKALGGN

SEQ ID NO: 6903 - protein, 3102 aa, Lactobacillus casei
MAFINLKRNKNVKETNFKMYKDGKHWVFASMFVLALGFGSAQVSQSQQVLADDSVATSSQVAAPNTKDATVSAASQNTSSTASSAAESSAATPSQPTATVPTSTASVATSSEAPSTVDPELVKSVSAELATVSSYAAIAESYASRAAGNANASAAATKATQAYNSALDVQKLVNHYATLASMYAEQKNNAAASTATTNAKSAASLIGNYAGLASTAAHDAAVAAMPSILAAQSSAAAATASVADRARGQASAATQKVTSAYTATQYAAGNNDVKAAYLAASSAAVSASQAATAAAQAAASAATQYQAASSAAASGNFDAVVAGDAILAQFKTQADTADVQAITQYNAASSSAEVANSLAIADFRAKTTSSASLAASTADSAVSLASSTASAAKTVQATSYAGQSTSLANQASSAAAVASSNAAIQPASVQVANSLAGVNSSVAAAALSYAAAAQKAASLAAQFNKDISGTQSAEKSDTPEATLSLVTSTNALTLGGTANLSTTIGNLGPNNKVQGTPTYNWYESTDGKNWQKISNSDASLAFKPDFAGTYFFQVVASGTRSEWGVFTKTFSAASNTITILVSDPKGSYTEQAQAANSKAANYASAANTAEQSASQAITDLKNNADTSGQAAAYFASLANSYAAIASAAATTANSLAKATSEAAVSASTAESSGQYASAASYAALASSAAVALSSAAAETSSAAAKTEESVNSAMGAAAGDPSSVEHDKTAEYLTSSYATKASAAASAASQAASLASSEYAALANAFATLDPALTSNAQTYLSQASQALSLATSSANDASSQAALAKSAGSDFTKASLAALTANTTMSQAYQQASAATSVRSEGIAKIFANQSKVYVDQITAATSAATAAESTANSVAAVASSASALKNTSLAYAYASAASSFAQQVDLNRGSELIAATQAVNQLSLASSAVAANDLLAASSYATAASSAAVQASTFASMATSNAATASSLAERVKNYSLDTTSTKGAVSSDAWVPLGIVVAQGKGVSPQNVSTVTGGKTVTLAASYYIGFRPFDTTWAVTWYVFVQGKWISVADASQYIKDFHVTNAVVNGKDSWFNRNALSTLTFKTTDYAGSLRFQASFQAASGFNDTGYSGVGQVDVYENDIHANRITIVNGDDYVLEGQKGSYTYATDPDNATGTVTWSSSDQSVATIDSTGNLTARKTGQTTITVTITNSDGSTHSDSKTVTIGNGLTDQTANVGTDITFIPQTTLDSGDIKYQWYKANSANDSGSAISGATSNSLTLNNVELTDGAYYYLVVSYTSNKKTQTIKLGPAKLTVNSIYATAASSAAAAASSSAQEVTDFANVASSYAEVANSYASNSSLQSTAASYAASAASVALSASSEANSYATLASSAAALASSAEVAGSTATASSAAATALLAASNAAVAKKNAIDAAATAEEYAKRATAEYAKIASESAIDAETAAKNASIAADAAAKAAASWPDDAAISSAAQSASTAASNAASYAVQASSAAVVATSASIEGNNSAASSAADEASTAASLASSEAALASEANSKAQATAAANTAANNHGSGNTGSNNSGDDNTGNGNTGSNNTGDNNTGNSNSGSDNAGDNNTGNSNSGNNNTGDKNTGNSNAGSNNTGDNNTGNSNSGSNNTGDNNTGNSNSGNNNTGDDNTGNGNKGSNNTGDNNTGNSNSGSNNTGDNNSGDKNTGNSNAGSNNSGNNNTGDDNTGNGNKGSNNSGDDNSGNSNSGSNNTGDNNTGNSNSGNNNTGDDNTGNSNSGSNNSGDNNTGNSNKGSNNSGNNNSGDGNTGNSNSGSNNTGDNNTGNDNTGNGNKGSNNSGDSNSGNSNSGSNNTGDNNTGDNNTGNSNKGSNNTGDSNSGNNNAGSNNSGNNNTGDDNTGNGNKGSNNTGDSNTGNSNAGSNNTGDNNTGNSNSGSNNTGDDNSGNGNKGSNNTGDDNTGNGNKGSNNSGDSNSGNNNAGSNNTGDNNIGNSNSGSNNTGDDNSGNGNKGSNNTGDSNTGNSNSGSNNSGNSNTGDDNTGNGNTGSNNSGDSNSGNNNAGSNNTGNNNTGDDNSGNGNKGSNNTGDSNTGNGNKGSNNTGENNTGNSNSGNNNSGDKNTGNSNAGSNNSGNNNTGDDNTGNGNEGSNNSGDNNTGNNNAGSNNSGDSNTGNGNKGSNNSGNNNTGDDNSGNGNKGSNNTGDSNTGNGNSGSNNSGDNNTGDDNTGNGNKGSNNSGDSNSGNGNTGSNNTGNNNAGSNNSGNNNTGDDNSGNGNKGSNNSGDNNTGNSNSGSDNTGDNNTGNSNSGSNNTGDNNTGNSNSGLNNAGDNNTGNSNSGNNNSGDNNTGDDNTGNGNKGSNNSGDNNTGNGNKGSSNSGDQNTGNNNSGSNNFGDGNTGNNNAGSDNTGDNNTGNSNSGSNNTGDANTGNGNKGSNNSGNNNTGDGNTGNSNSGSNNTGDANTGDGNKGSNNSGDNNTGNSNAGSNNTGDNNTGNNNSGLNNSGDNNTGNNNAGSNNSGDSNTGNGNKGSNNSGNNNSGDGNIGNSNTGSNNTGNSNKGSNNTGDNNTGNSNAGSNNSGNSNTGDNNTGNNNAGSNNSGDNNTGNSNLGSNNSGDGNTGNANKGSNNSGDGNTGNSNSGSDNTGDNNTGNSNSGNKNTGDDNTGNGNKGSNNSGDNNTGNSNAGSNNFGDNNTGNSNSGSNNAGDNNTGNNNAGSNNSGDNNTGNGNEGSNNSGDNNTGISNIGSNNSGDNNTGNDNTGSNNSGDSNTGNSNAGANNYGDNNTGNSNAGLNNSGDNNTGNSNVGSNNSGDNNTGNSNAGSDNFGDQNIGHSNVGSNNTGNNNHGNNNTGNGNIGSNNNGNSNQGNNNQGSDNVGSNNVGNGNIGSNNQGNNNSGNNLIGDNLRSPVVVIHDININNDAAITADTIKSMITSITDIYGHSLDPASLKYVLVSAFTKAQNQTASDSIPANTIEFILTKLADQSGYKVEIAFGTRFVNGHDSGSGAVTYATAQLMFNGKTSQHELPGTGGGESDEKPSDHVTKPSDTAKKPEPNDHRVGNTSNSDKNRVDTNTHSGNKTINGNARNGNARRQLPQTGDEQATSLSIWGLLLAGFSLLLGGLKKRKRSDD

SEQ ID NO: 6904 - protein, 506 aa, Lactobacillus casei
MFYFLTSAIDYNNSGIENAQMKRLILFQKHNVPAKIATFTYARYQYLYLTRESLMPDDVVNLYDFFQSRLFYHGPRENIANFKVVNADAEDNGMNVIYRRKGQKVMQVWTFTDYTFYEKGQIERVEYYGTNGKLQRKDLYDVRGFLSSSIYYAASGGHDRQVFYDAVGVPVIVKQFQNVKGDQAERIWLRYYARSYYFDSDDELTGFFYDQLVKQDAEGMIADRSYAVDPGIYHMQQHVYTISFWHNVHTAADAPLTGALSETLGAEIKEASRFQGLFTSTHKQSSMIAKRVKSFPIKTVPAGFVTDQTLAEKHVPFDKRQSHHIISVSRIHEQKRLEDTISAFVQIRQAVPDATLSIHGYINDQKLMDQLQKQVNDAHLHDAVTFVAYTPDLTSVYNNAQLMLISSRYEGFGLALLEAQSHGVPAISYDVNYGPSDIIIDGKSGYIVKNGDIHALAEKAIALFKDDQLLRQLSDGAYTSAARFSENKVWQAWQDQFIQPAREQNK

SEQ ID NO: 6905 - protein, 517 aa, Lactobacillus casei
MIYLMTDVIRYEFSGIDYAIRQRYRLFKEMGVPVKIISTIYNRFSDLNRFRAGIVAEDCINMNDFFQQAVLYHGPRRTLADLDFGNLVTPVRQARQVHYYKGRYRVVTVTLAKPDSGYPSAPDQIDKIDFFGHRDQLLQTDYYDVRGFLSMRHIFDEDGYLTTEQMMRPDGKVGYENTYQKDDAGHSVLQETTLQTDDGLSIFTTRQELITAFLSRLQAIGQPAYFFADWPEMGDAPLFALPTHPKVIAVRHSAHTQDPNDPMKSPYVDRVQQEIDHPESVIGFVTATKSQAADLHQRSGVKTWAIPPSYNESTLLEKSPVPLNHRKKHTIISVARIHPEKQLDQLIEAVRSIQQRVPDVQLEIYGYVNYQSYYHKLQKQVAEAHLQDHVRFMGYVPDLSKPFDQGTVLALTGYYEGFNLALMQSLAHGMPAVAYDVHYGINEQIKDGQNGFLVPLSDRTTLANRLTQVLTDADLWQAQSVAAKKLAQVYSKAHVVAKWRAFLDDLQVPVDGKIQNK

SEQ ID NO: 6906 - protein, 301 aa, Lactobacillus casei
MSENAVVFCVTRLHLQLTAVAITSILENYQNTQPLQILVVCEDVQQPDIDYIKTLPQKFGLPQVTVDFWSKPSEVDQISPDFTIGEGVPVPPMAIWRLFTPNYFANYQKLLYLDNDVIVKTDVSRLFDLLDEHHVLAAVPDFLFAASKNYYEDQYPAEELYGMKSMRHYFNNGMMIINTAQFNQMIPVDKLITTINTTHWHLADQTILNILLEGHVQLLPWRFNYQHDLTYLHNPDYHWDPQLVQKIIDDYARIVIRHFAGSGFLALPYEHVQVSDEWDLEFWRLLEKVKKASRVSRPSQD

SEQ ID NO: 6907 - protein, 299 aa, Lactobacillus casei
LEQQAVVFCVTGPHIQLTAVAITTLLQHYHQQTPLKILVVCDHVLQADIDLIRSFPQQLNRPAASIDFWAPPAWAKDLKPYQMRGRTGSTPPMAFWRMFLPAYFSNYQKLLYLDNDIIVNTDVSKLFEQLDDQHTLAAVPDFLFAASKDYELPSKVDTMYLYGMADMQHYFNGGVIVMNVARYNASYQPGDILKLIQTTSWNLADQTLMNLMFQESTLLLPYRYNYQHSKKYFTDPYHWDPERIQPMLAAYPHIAIRHFAGEGPVSAPYQHVALHDEWEAAFWQALHQVRLLASKASQL

SEQ ID NO: 6908 - protein, 307 aa, Lactobacillus casei
MSKNVIVYCVTGTHLQLTAVSIATILEHYQAKRDLQINIVCSGVRQPDIAFIKQLPAIYGKPMVTVDFWSIPQEISKIRPDFTIGSGVPVPPMAIWRLFMPNYFNDYDRMLYLDNDTMIETDVSNIFAQLNEPYVLAAVKDFLFATDVGYGPANFNAKEAYGIDSMRHYFNNGVMLIDVAKFNRLIPVTRLLHVINTSNWYLADQTIINILAAGHVKYLPYRYNFQHSLAFFDNPKVDWDPQLVKTVTDEYPHILIRHFAGTGRLTCPYQHVRLADEWEEEFLRVLINVKRLSFNISPIHTIQPEIK

SEQ ID NO: 6909 - protein, 796 aa, Lactobacillus casei
LKLREHLALHKYVKLAKQVIAKRDIYRAMSDKELKAQTLHFREALKSGKSLASIMVPAFAVVREADRRVLGMEPFYEQVLGALAMQFGNVAEMKTGEGKTLTATMPMYLNGLAGPGTFLITANAYLANRDAEDMGRVYRWLGVSVTAGVSKEGQEDEDRDVDDIYQHDIVYTTNSTLGFDYLLDNLSGPEKPKYLTHFRFALLDEIDAVLLDMAQTPLVISGAPRVQSNYFLLAAEVIPLLQADRDYVLSDDKKKVWFTEAGIALLEVYFGVDHLLSAKWRDLYRHLVLALKAQFLFIRNRDYVVVDHEVKLLDITNGRELQGMRLEAGQHQAIEAKEHLPISDQTRSMASITYQNLFRMFTHLCGMTGTAKTDAAEFRESYHLDVVIIPTHKPNIRQDKPDRLFLDTEHKIYASVDMVKQAYAEKRPVLIETGSVTMSNLYSRVLLKAGIPHNLLNARSASKEAMIVKEAGQPGTITVATSMAGRGTDIHLGKGVVEKGGLLVIGTERMDNARIDNQLRGRAGRQGAPGETVFFASLEDRILLEHGPNWLKKFRRKYRGHAEKLPQPLTGHRFRRLINHAQAASERSGRDSRFQTLEFSEVMRIQRETIYRTRDEIQASQNLEAAVDKLLNRTIDEFLADHHQLNEDQMMDFILNVISAQLITDSMTIPAVEGLRPRQTKKTVKPFLRQLMDQQLQAQHQLLPSQDQFDYFEKVSLLKALDTAWIEQVDTLQQLRSTANSRASAQHNPFFEYQKDARDAFHRMTGDFAQRAVKNLMLSTIHKNPNGSVQVGFPEA

SEQ ID NO: 6910 - protein, 407 aa, Lactobacillus casei
VSNKHDMLIRSLWTALILGIVALGQLVLLPGTDIASASEQLKSVPFLQLVAGATGSQLQNATILSLGMRPYMTGMIVWQAIQMLFDEQVQRWTLRKSGIAQRFITLFFAFIQGFEMVYVMRSAIKPIYLPGFSFNFGLVLVWIILIGGAMFTTWLADLNMAKGVGSSVALIIPSLVFSLPNVLNSGFYQRRHPISEQEYIIAGIVVLVFIVVMTIINEAELHIPIERPLLENELAKSYLPIRLLVAGSMPFMFSSSLFTLPTYFVNQTVGPTSEWQRQIIKWFSYNTPQGIFSYAMVMIFLGYAFGYMNMQPSKLAKNLKESGDYIIDQVPGEMTNRFLLRHFSLMSVWGNSILVVIAITPLIIGLKYPPVANYSVMLGQILILVTIMDTVDSQMRALWYKNRYQVI

SEQ ID NO: 6911 - protein, 545 aa, Lactobacillus casei
MLYLLPNWPQTPKLLEEESMVNLAHLFSAHDQPFELLFLRPEPWLRRTLKENDLLSERWWSVFDAIQDVPFQAGQPVDLEDLGMPADVERIFSQSQVTLNRQDELYAVIKTFKTGFILSVEFPEGKIGKEERVYDDRGFWSYSRFFDAQGKVIRRVWYDLTGSIVMTEEASGQVTIGTQAARRFKQHQYANLDQVILEKLNQHLAMAADPHIVAMAGMAQPMLKAIMAGYPVTMLVEEHLARQERQSVRAVAEQATEIISPTDHYAEQLKKQLGTGADQKIQVIPPYATTLALGVSNETDQTNVMWYVNQLNAERLAVVFPQLLAMLSQENRRRLVVVADNDDQVAHLQQLAINFFANLQGISPDSGIFAEITKAIQKWQDDQAHAGDNVTVENAQMPLPPAQTDSEADRAANQKTLKIQQTAFQVFQMLTHLHYAVDPEVGQLKQWLHSSRLLVDLGDQPNLLLQIGAISVAIPQINRHETGYVQDGVNGRIIDQDRALADALSGYLDQLSAWNRTVVANVKLIDQHDDDQLMRLWKKVLTHGR

SEQ ID NO: 6912 - protein, 544 aa, Lactobacillus casei
MADNAYPVLQLGTQAIPLQEHLTKDFAFEFISNAAFNTAPTPPATQPDKSDSEGEPEEKTDQLPISLWQNADMTRLRREYATALFIITEGAAVLKQPDQLIGLPANTIMYDETLSLTPEIIHILDLKQAHPISLDHLDQLGEQIVLFFYPAQWGIRVPFGRIEIADGFSGSVMQQGSVGVTLKGDFGRDLQPAVYWRGSLGIGQMEAIAISIECETVGDVEVWAKLQMVNPQNFQIAQKKLIPLSAFRDDTILDTKAGFRFVNITLMAKGSGTVKIRQVHLRRSRGSYGTMFIGGKRLKAVKPLDGELLSYFDAGDLKPPLSVYFSGYRSAEGFEGNFMMKAMRNPFLLFSDARLEGGAFYLGDPQLENQVVEMIQATLKRLGFRPDQLILSGLSMGTLGALYYGAKLDPRAILVGKPLINLGTIAENGRVRRSADFATAFDMLMMFNGSATHESAKKINQRIWQTISGGKFDHTLFAIAHMLDDDYEHHAFDEIVKWLNRRQQHNRVLHIGLHGRHNDNTNEVNAWFLRQYHMILTQEFGRSF

SEQ ID NO: 6913 - protein, 254 aa, Lactobacillus casei
METAYLFFWRRMLDTTFNYGAQVTYMADGTVQFEAPMMPPGKTIHAWTTTKDFEHNLQLAELPVLTPGETYALALNWEVKEDSVFCQIVFTDASGLEVGSEVLEDGKGTFTFPLTAYAYEIRLKNMRHEQVVFHYGMIIPVSVYNHFDIAVNLNHALVTFRARKQTDEPQVLGITERSSLTKPLWLPQAARTIFVVAANAKQLLDPQWCQETAAFLKAEFDPAFGSLTVAYQVGRHLGHLRQALRAAFSKKIEK

SEQ ID NO: 6914 - protein, 480 aa, Lactobacillus casei
MIFFMNRAMGIGNSGVEHAEFYRAKLFDRLGIDYRFVMLDVVRELREAMAKWQIKNRKMINIWEYFTFGDDYLRHGIEDLITPKDHTLIDGTNTYRIQEYITSGGLRIVNHLVKYPDKHKKSNVLLVSTGRTEIFNQRTGEKRVMFSYVDDQHRGMLMKDIHLYNQNGQHLFFANEVLMIRYFMNKLNDFFGHNSTFIIDRGEGVEMAIDYHRPVGSHIVNIVHADHLSDRDDPENPLWNNHYEYLLTRLNRVDRVVVATKLQREDLIHDFPQYAKKFVAIPVGGVRDQKTAPVKTALGDPIRLITASRLASEKHIDLIIRAVAALNKDGVHYTLDIYGGGGEEMKLNQLIDKLHAGDYVKMKGQTNQLDKLYPKYDAFVSASFSEGFGLTYIESLNAGLPVVTYKARFGAMELIKDNVNGFLQDFKRDDTQYNVNQMVTGLKRLKAADYQKLCGQTFSSVAAFQDHRIAGEWRKMLDEL

SEQ ID NO: 6915 - protein, 286 aa, Lactobacillus casei
MNYEIVNQLEAGQPGWDAHKAVLKQTNTQLLVLGPLPGFYGFLKDEHLQGVDLIDTITQRRYIDHKYMFFDKAPVPEGTAVYMNEDGTISLISEGETIGSMVTYAGTRRAVKELRYQYLDGTKDLIEEYSFDGNHYSNLFYYNDDIQEIQFLNRDGKVVIREFFYEGAINLITVEDPLSGHELRRYDDIEAFREGEIARFLKPEDTAITRYMGLEMTALRHAKSHNVLRLSESPFDENSEVRGNLMAILTNDIAYIHEVQMDQASYNALALRDVPLDKAKVVTEAR

SEQ ID NO: 6916 - protein, 7344 aa, Lactobacillus casei
MSRLNPQRQKRLFETNSKSRFRMYKAGKQWLVAGIATLSGLFGMGAVASSPVHASTSNTAGVGKEAGKQDVLATQNQATIPASSNTTSQSTSESTSTSASESVSASQSVSASDSKSTSDSTKNSQSTSTSSSISAASASVSESISKSESAAKSGSTTESQSNKTTQSESQKKSESTSNQPASKETSVSVSESTSTSTNPSKQASTSSSESTTGKQSTSTSESQSLSTSQSTSLSISEQSLSDLAAKTGELATTDINKLTAMMAQAKTAAADSEFTITDQKDFKSGESAAESDLKSIIKNIDLKGFGVAFNIGNVKAAVNQLAALIDDYIKNPTLYTNTTITDSKTGTNAYDPIWKPDNRNGSDWPAADNWLDLSTYGHGYKVNSSLPSFNAGYVTYLRSYAKGILDDLTAVKNQSTNPDAANSLINNTTYRSGDLSGSSLGGVIANGLSFIWNSFWNNYNVPKVLQVYTDSSVAASNVNTTVGYLNNLVGLVAPYIINGIAHQALSDIRSIGNAKMGADGKIDYAPDKFTDAVALNGNIKSFLGLVGLDGVISSTLMQRIYDSIKTVAQQAIMNNWATGEYKALQNLMNNGIYDDGSNTYKATGYDVNNPAAVTNSNQANLSDTTQAAAYAWAMKVFTPLLQKAASDAWSGSPADNIDELIDSLSVSDADKALLKTDNAQNTASGLKNYARSAEGAREMIQQIYSKEYQAVAKALYDFRTDPTYTDAQLAQRQKDADLNFEPVGDPALNGGGGTATTLEANDYTRTYQFLRDAMYQGQANADIKSHSQKDGKVDPLKPDPTEFTAQKSILSSTLTPLVDDLTNFARPYYSYAYQVEAIRANNAFAAGLAKAHEEIAANPAMPVPDAGDAGKITVDGQDYSAKDDTTASIYTTVASAVNKNAPAAGQAFTDGYQSILTEVTVTLQAKSGETGFPDAKTYTVWAPTDQLTNIGAPTVKGWIPEPVNAANTFTGKTGQITFTYHKGASIDNISITNPTDSRQYNGELLNYPDIDPTITITWNDGTTTTTQSLKFSSISGFAGDMHEYFNFAYTSDEGKWTIQLNQNGADAVLSWIKNQLKYDGTSFEVPDSALDLLPQQFTYSITKQVAVTSKKNVNYIIGNDLPTAKDLYDYVVVNGVKYDASQVKWNADGSKGTIDGVGTITLNWNKTKDDLQTAGTYTDAADLQLTLQDGTVAKDAVNVISSSAKHDVTVNNNRTIVYVIGGDKPTAKEAMNGSGAYIEVDGTKYTTDDIKWSSDGNTGTITTKDGKTITVTLEWSKGTEDAIETAGLHSNAANVEVTLSDKYTAAGALNVYSTTNASTDAQVDSKKNIGYTIGHDLPTAKDAFDAVVVNGVVYTADQVTWNNDGTGTIDGVGTFTIDWSDDAQKTLQTEGMHKNAGTLVFTRQSDKKQFTDSFNVYSAPDYSKQSTSASESTSMSDSERTSTSASASTSTSTSASLSASESATESNSISQSTSKIQSESVSASDSKRQSESAQSSQSTSESTSVSMSESSRADTSNSASTSTSLSASTSAKESTTKSTSKDVSESDSASHSTSMSTSTSSSESSRASQSESASLSGSVSASESASTSDKDSTSASTSESQYESTSSIASGSDRKSASTSASVSTSASASGSTSESDVKSESNSASESLSASESDSRNGNNSGASISQSASTSASTSVSVSTSESTRSSESVSKSDSQRDATSKSADNSKTASESGSVSASTSASKSLSERRDESKSASTSTSLSASTSTRESNSASASNSASQSASTSTKASTSESQSSSTSNSKQNSTSTSASASEEQSTSDNKNASVSESNSTSTSESEQASTSASASTSTSKSKADSTSESTSRSKEGSGSTNKDTSASTSASLSTSTSDSASTSASGHASTSTSLSVSESTSASQSASASKRDSQSTSTSASTQTSQSASTSDSDRDSTSTSANDSTSASKSESTSQSDRASKSDSASDSTSTSESKGAGSESTASQSTSVSTSTSDSASKSDSESKKASNSASMSESKQASTSSSTSTSKSDSTSTSKRESTSASTSTADSTSARQSESNSVSTSQSDSASKSTSESKQTSTSQSDSTSTSYSESTSKSKSEIHSSSDSASNSTSQSASTSTKASTSESQSSSTSDSEQNSTSASASTSEKQSTSDNKNASVSESNSTSTSESEQASTSASTSTSTSKSQSQSTSESTSRSKEGSGSTSKDTSESTSASLSTSTSDSASTSASDHASTSTSLSVSESTSASQSASASKRDSQSASSSESARTSQSASTSDSDRDSASTSTNDSTSASKSASTSQSDQASKSDSASDSTSTSESKGAGSESTASQSTSVSTSTSQSASTSDSEENKNSKSTSTSESRQASTSASTSTSKSDSTSTSKRESTSASASEADSTSTRHSESNSVSTSQSDSASKSTSESKQTSKHQSESTSSSYSNSTSKSQSAIHSNSDSASKSASQSASTSTKASTSESQSSSTSNSEQNSTSTSASVSEEQSTSDNKNASVSESNSTSTSESEQASTSASASTSTSKSKADSTSESTSRSKEGSGSTNKDTSASTSASLSTSTSNSASTSASDHASASTSMSISESTSASNSASASKHGSQSASTSESARTSQSASTSDSDHNSASTSANASNSASKSASTSQSDQASKSDSASDSTSTSESKGAGSESTASQSTSVSTSTSQSASTSDSEADKNSKSTSTSESKQASESVSTSESKSDSKSTSNRESTSASVSEADSTSTRHSESDSASASQSDSTSKSYSESKRTSTSQSDSTSTSYSESTSKSKSEIHSSSDSASKSASQSASTSTKASTSESQSSSTSNSERNSASASASTSEQKSTSDDNNASISESNSTSTSESEQASTSASTSTSTSKSKADSTSESTSRSKEGSGSTSKDISESTSASLSTSTSNSASTSASDHASASTSMSISESTSASNSASASKHDSQSASTSESARTSQSASTSDSEHNSASTSTNDSTSASKSASTSQSDRASKSDSASDSTSTSESKGAGSESTASQSTSVSTSTSQSASTSDSEENKNSKSTSTSESKQASASASTSTSKSDSTSTSKRESTSASASEADSTSTRHSESNSVSTSQSDSASKSNSESKQTSTSQSDSTSTSHSDSTSKSKSGTQSSSDSASKSASQSASTSTSQSTSESQSTSKHTSENGSASDSTSESTSTSASEHASESVSASTSASKSTTGAASASTSASNSTSKSISNSRSESASRSNQNSESISKERSQSASASLSDSSSKSASTSTSDHAPTSGSMSASTSSSESQSASESSQDSKAASTSASERDSRSASTSDSERNSASVSASDSTNASKSASTSQSDRASKSDSASDSTSTSESKGAGSESTASQSTSVSTSTSQSASTSDSEENKNSKSTSTSESKQASASTSTSESKSDSKSTSNRESTSASVSEADSTSTRHSESNSVSTSQSDSTSKSYSESKQTSTSQSDSTSTSYSESTSQSQASESRSESVSGSQSASTSTSASANESNSESASKSASQSASTSTKASTSESQSSSTSNSEQNSASASTSTSEKQSTSDDNNASVSESNSTSTSESEQASTSASASTSTSKSQSQSTSESTSRSKEGSGSTSKDSSESTSASLSTSTSDSASTSASDHASTSTSLSVSGSTSTSQSASASKHDSQSASISESARTSQSASTSNSDRDSTSTSANDSTSASKSASTSQSDQASKSDSASTSASKSTSRSMESGSDASASESTSTSTSQSTSTSTSESKQASTSTSKSVSEQNSESVSTSTSKSDSTSTSKRESTSASTSESDSTSTRHSESNSVSTSQSDSTSKSYSESNQTSTSQSDSTSTSYSESTSKSKSEIHSSSDSASKSDNQSTSTSTSQSISESKSSWNSNSTQNSVSASASYSEEKSTSDNKNASVSESNSTSTSESEQASTSASASTSTSKSRSQSTSESTSRSKEGSGSTSKDTSESTSASLSTSTSDSASTSASDHASASTSMSISESTSASNSASASKHDSQNASTSASTRTSQSASTSDSERNSASVSASDSTNASKSASTSQSDRASKSDSASDSTSTSESKGAGSESTASQSTSVSTSTSQSASTSDSEADSHSKSDSTSESKQASTSVSTSTSKSDSTSTSKRDSTSASTSESDSTSTRHSESNSVSTSQSDSTSKSYSESKQTSTSQSGSTSTSHSESTSKSKSEIHSSSDSASKSNNQSTSTSTSQSISESKSRWNSSSKQNSVSASNSASEEQSTSDNKSASASESNSTSTSESEQASTSASASTSTSKSQSDSTSESTSRSKEGSGSTSKDTSESTSASLSTSTSDSASTSASNHASASTSMSISESTSASNSASNAKHDSQSASTSESARTSQSASTSDSEHNSASVSASDSTNASKSASTSQSDRASKSDSASDSTSTSESKGAGSESTASQSTSVSTSTSQSASTSDSEENKNSKSTSTSESKQASVSASTSTSKSDSTSTSKRESTSASASEADSTSMRHSESNSVSTSQSDSTSKSYSESNQTSTSQSGSTSTSHSESTSKSQSEIHSSSDSASKSASQSASMSTSQSKSESQSTSKHKSDNGSASDSVSESISTSASAHTSESVSASTSASKSTTGADSASTSASDSTSKSISNSQSESASRSNQSSESISKERSQSASASLSDSSSKSASTSTSDHASTSGSLSTSTNTSESRSASESSQDSKAASTSASERDSQSASTSDSERNSASVSASDSTNVSKSASTSQSDRASKSDSASDSASISESKGAGSESTASQSTSVSTSTSQSASTSDSEENKNSKSTSTSESRQASTSASTSTSKSDSTSTSKRESTSASTSESDSTSTCHSESNSVSTSHSDSTSKSYSESKQTSTSQSDSTSKSQSESTSQSQASESKSESVSGSQSESTSKSKSATQSSSESASNSANQSTSTSTSQSMSESQSTSNSYSKQNSVSTSTSTSEKQSTSNNASASVSESNSTSTSESEQASTSASASASTSKSQSQSTSESTSRSKEGSGSTSKDSSESTSASLSTSTSDSASTSASDHASASTSMSISESTSASNSASASKHDSQSASTSESARTSQSASTSDSERNSASASAKDSTSTSKSDSTSRSDQASKSDSASTSASKSTRRSMESGSDSSQSESTSTSASQSTSTSTSESKQASTSASKSESKRNSESASTSTSKSDSTSTSKRESTSASVSESDSTSTRHSESNSVSTSQSDSTSKSYSESNQTSTSQSDSTSTSHSESTSKSKSEIHSSSDSASKSASQSVSTSTSQSKSESQSTSKHKSDNGSASDSVSESISTSASAHTSESVSASTSASKSTTGAASASTSASTSTSKSISTSQSESTSRSNQGSGSISKERSQSASASLSDSGSKSASTSTSDHASTSGSMSTSTSTSESQSASESSQDSKAASTSASERDSRSASTSDSEHDSASASANDSTSASKSASTSQSDQASKSDSASDSASISESKGAGSESTASQSTSVSTSTSQSASTSDSEADSHSKSNSTSESKQNSESASTSTSKSDSTSTSKRESTSASTSESDSTSTRHSESNSVSTSHSDSTSKSYSESKQTSTSQSDSTSKSQSESTSQSQSSESKSESVSGSRSESTSKSKSATQSSSESASKSDSGSVSTSTSHSISESQSVSKSESQHESQSNSASKSKSNSGSSITSESMSASTSASISDSDRASTSVSVSVSTSQSASTSASESTPNSTSKDASASTSASASTSGSASTSLSESNSASKSVSTSQSESTSASSSASASDHDSTSTSTSESQQASQSGSTSVSDRQSASASASDSKSTSISTSTSESVRASKSDSASDSASISTSKSMASGSDSSQSESTSTSASQSASTSTSESKHASESDSKSESKRGSESASASTSRSDSTSTSHEESKSASASTSRSESKRNSGSESISASKSDSTSTSTSESASTSTSSSKSQSTSDSKRQSASDSTHESQSASMSGSTSQSLSTSKSASVSESKQQSESQDRHDSDTASTSTSTSESEHNSESKSSHDSNSNSASQSTSESQSASSSTSTSESANGSASTSASESRHNSDSASTSGSISVSTSTSTSQSEKTSKSDSSSKSESQSASQSISESKRASTSTSDQGSKTESESASASTSTSQSNSTSASESISASVSVSQSSKQSTSDSSNPSQSASASESTSTSESQRTSASTSASTSESMSASTSTSGSTSFSESVSTSESQHGSASASASDSTSVSTSDSASASNSAEKSTSTSESKEASASTSASLSISGSTSTSTTESTSASASTSTSESEHASASASASQSTTKSASTSTSESRHASQSSSNSASTSTSTSESASTSTSRSESKDDSASVSASTSASTSQSDQSSLSHSDSTSESISTSTSKSKSASTSASASVSNSDSTSRSQYESTHQSESESTSRSQQASTSTSMSQSLSTSDSASASSSKRQSESGQASISTSASTSASTSASGQVSQSDSSKNSTSTSVSTSTSESQHASASTSTSESGRHSTSASVSGSESDSQSTSTSESASASQSSSEAGSKTGAASASASQSDSQSTSTSASLSGSASISTSQSESTSNSGSTDPEKSTSASTSMSTSASKRTSESVSASTSKSTSTSQSASESTSFSTSGSISESQRDATSASASVSTSDSASASASQSAEDSASVSMSDSQQASASTSASDSTVKSASTSTSESRQASQSSSDSASTSTIKSESASTSDSQSGSAMASASVSASTSASTSESAQNAASASASESLSQSTSESTSTSASESLSVSASTNASTSESSYTSTSTSASTSASESTSASASTSDQIASQSSASQSASQSKQASASTSTSESKRASTSASMSDSKRDSQSESSHESSSDSTSTSTSESTSASASTSMSASAQDAESISASDSTSTSASESTSASASASTSAAHDQSTTESESTSASESSSRSASESTSSSKEASTSTSTSKSESASSLPNPSKSTSASVSTSTSESQEHSASTSASESAENSATASASASTSYSESTSTSESQAASTSTSASVSTSGSTSASDSRSKSASNSTTGSESQRTSASVSASTSTSTSQSDSTKESTSASQSTSNSKSAHDSKSTSASESDSHSASQSTSYSISESVSTSTSESQQTSASDSTSSSTSQSASISTSISTAPASRSASTSESVSASQSASESSSTSAEQSVSASVSESESHRQLPSTSGSTSASTSTSESVSASESQSTSASNSSASASASASNSGTSTSNSSSASGSESMSSSANTSTSGSLSTSGSMSTSVSGAYNPSMHKQLPQTSDDAGSSSVASIGMLLLTLTALMALKKKKRHDGAR

SEQ ID NO: 6917 - protein, 483 aa, Lactobacillus casei
MTETNFPEGFLWGGATAANQLEGAYDGDGKGLSTSDLLLGGSVNVPRKITRTVDPRAFYPSHDAIDHFHRFKEDIALFAEMGFKVYRFSIAWTRIFPTGLETEPNEAGLAFYDQLIAELKRHDIEPLVTISHFESPIGLTKAFNAWASRDMIAAYTRFAETIITRYHHDVRYWLTFNEINMLTRPMGAYLAGGMYVDDSDRFISPDTDSEQLRLQALHHQFVASALVTKFAHELDPQLQVGCMLAYRMLYPYTSHPDDIAMVQRATEFNNFYCGDVQVKGHYPYFARRYWRDHHLHIDMAPEDAATLAAGTVDFYTFSYYQSSTMTCTGEGEKTGGNFFSGVKNPYLERSEWGWEIDPRGLRTALNQIYDRYQVPLMVVENGFGTRDQLIEQNGVKTVNDDARIAYLKAHIQAMGAAIRDGVDLVGYTSWAPIDVISASTGEMAKRYGYIYVDKHDDGTGTLARYRKKSFYWYQQVIQHNGLV

SEQ ID NO: 6918 - protein, 628 aa, Lactobacillus casei
EIIBCACMPNENTMTNHPKITDRIMQAVGGVDNIKSLSHCATRLRFVLIDKTKFNTQQLEQIPEVLSAVSSGDESQVVVGAKVTQYYAEIMKNYAIRENNTTSNPAASSEKNFLKRVLNAIVNIMAPIITVLIAGGLFKVVIAIMALCGLDPKSVPYLTLSFMADAAFYFLPFMLAVSAAKKFNTNTYLAMMMAGVLLHPNFTAMVAAGKPIALFGAPIRLASYGGSVIPIILIVWFMSYVERFAEKVAPDMIKTMLKPLLVALITAPVALIVIGPIGSMMGDGLYAAISVLNRHVPWLVPTLVGAFTPLLVMVGMHVSLLPLATLSIGRFGSETIMGPGMLASNIAQAGASAAIAVRERKARGRQIALSATVTALSGITEPALYGVTLKYKRALACVIVSGGLAGLFAGISGLVRYSFGSPGIFTLPVFIGANPDNFRNALITVAIAFGLTFITTYFFAVVPDSTVATTAKPTTQQFKSVVAGRIVPLSQLDDEVFASGSLGHGVAIDPEADTITAPCDAKVTMVYPTGHAMGLTTANGQEILIHIGINTVNLKGRGFKTLVEHNQEVKAGQPLVQLDLSLIRQEGFDPTVIVLLINTAAHQIDVHDQPTVTNEDALLTLRQPMPEA

SEQ ID NO: 6919 - protein, 276 aa, Lactobacillus casei
VFRIKKVLNVNVVLAEQNGDEYIAFGKGIGYHQKVGVTIPDTAVFKKFMPLDDSRKSEMIQSLNRIPAVYISMTSQIVTYAEEKLQASLLPSIYYALTDHLHFSVQRYHAQQALGNRIYWEMKTYYPDIFTIGEYGLTVVRDTLEVTLPKEEAANIAFHIINATPAATAKANVLEVTQLVDNVLQAVRALTGGTIATTSLHYERFVTHMKFFAERYLSNTMLEDDGQLLVNVYSLYPEAAKIALKVDKTIMAIYNKPPTKEELAYLIIHIHRVLIG

SEQ ID NO: 6920 - protein, 879 aa, Lactobacillus casei
MLHFKKAKTWPLLLVSFALTFIISLCVFAALKMAPFGSSSILANDSAVQYIDFFTYLKHALAGTAGKAYSFSNSLGGGMYANWTYYLLSPFNLIFVLVSRHALPVAMLFVTALKYSAAAVTAQCYASHHAGARWYTLVFSISYGLSGFLVANFLNIMWMDGVILLPLVVLGIDRLFETHRIMPYVLPLSLSFITNYYIGFMIAIFAVLYFGWRWAIHHQTHLLRKIGLFAGGSLLSGMLAAVVLIPTYFALAASRLSSAGADFSVKALYSLLDLPSKFIPGSFNFDQLSNGLPNLYMGMIALLGAVFYFLAASIPVRERLISGGLTLLLILSIWLNPLVLIWQGFRAPVWYLYRHSFIVIFWLLVLSLRGLAHLPSVSRFRLGMASITTAGCLLIPTILRMATHKYVTVLNLTLGGVFLLVAALLLYSIRSRLLPQKWLVSGIVVLLVLDMGTNAFTSLKAISFVPAADFTVTSKVLQAGYDDAKKLGSGSFYRMNADSQRSMDDPYQYNFNGISTFSSVLNTSTINTLTNVGAIGSAGRVKNNDLTWPLESLLGVKQLLIVNTQSKKTGTKAYQQVASRIISNPRYDLSAYKLVGHNDYFNIYQNPDALPVATQIYRKIPTQVQANPVLQQNAYFETLSPQANQTMLTTSDFSGISVDNVKPLTTLTNAVATKVNKKNAASITLTVNPTSEQQYLVMGENMRKNMAISINNIPVKNDPDTGSKTVSMPINSTKPTTITLTFNRGLNQIDLDHFALYTLNRTAFKQTIATAKQKAPKQRIQNGRVTLTTKANNSGYIMLTIPYEKGWQVNSKNVTLQNYRGFIGLKVPTSRSTFTLTYHTPGITQGWWLTIIGVLVAIGVTVYEYWPSKRRHLKQTKRI

SEQ ID NO: 6921 - protein, 579 aa, Lactobacillus casei
MAIQTKSSDIKEFLKTNAIWLLPMLAVALVLLVQWPQLHLSYIFHQDDTMPQLRRMESYVTSVQHGAYFPKVFPEEVRHFGYSFDAFYPSLMLLPYVWLRLAGLGVVSAYYGYQTLILVVTVLAAYASFLKIRRRPLAAFVFSVVYTTAVYRMLDAFVRGALGENLAFIFLPIITAGMYLIYIKQSDNWFLLAFGVTGLMYAHMLSLVMVLEFLVGGFLVLVALRRVSWRMVRYTAYAAISSLLMGVGSYLPMLEISQHLPLKLAESATIWLNYLQYSLGDLFQNSLSMYASTSNMQNVNQTFRPGMGVLMLGIAIGLALWWPKLSRSVKVAAGLGFVTIFLSTNLFPWSLFRKTVLGTIQFPWRYLELTTLFLSLAVALLVAEKVRPQRFAWGMVLAACVVGFSYAATINTTMTNANTYRVTDKNAAGYYGDATGGGSEYAPKEFDPTTFFKKDQAVVLPSHKLQRLTPLTQHYNDLRFGYTSPRSVVLQLPKFAYVGYNVTVDGKVVPYRAQGKNARLTITAPAGSHRVRVVYTGTRLQHVTGWLSLAAAIIFFLSWIFVAIRNFDPEKSTTSEDPK

SEQ ID NO: 6922 - protein, 309 aa, Lactobacillus casei
MPQSVAIIIPCHNESENVPLIYQALMKTFQTDLTQLEPQIWYVNDGSTDDTLAQVQHLQESDAQVHYIDLSRSFGKEAAMYAGLVTAKADYYAVMDADLQDPPAMLPDMYAALQEGYDMAGAQRTDRSGEAPVRSFFSNLFYKFINRVSQTQIVPGARDFRLMTRQVVDAIVHMTERNRFSKGLFSWVGFKTKYLPYQNIERQHGETSWSFTSLLRYAIDGIIDFSDAPLTFVSMIGIISFLGAFAALIFIVIRAALYGDPTAGWPSMVSIFLMIGGIQLFALGIVGRYIGRIYIETKQRPIFIARKIK

SEQ ID NO: 6923 - protein, 212 aa, Lactobacillus casei
MKKLLPLLAVLAFLFVGCSATLNQKKQLLTTTQTVQTQVQQEQQALQVIGSTVNDFPSTFEKAYQDDPSADLKNDDGAVKKLLDKRAAAFKSLEAANTALTDANNTLTKLNNQPSEDMPQAPLSKVLTSLKLAKLDHKTLVSYYREMLSAEDDFFAATAGSDVSQADLETQISQLNQYYSSLNQQIDVMTANLTTVTSQNAKLTKAVKTMHD

SEQ ID NO: 6924 - protein, 321 aa, Lactobacillus casei
MHIGMRTVKTAVGTAVAMLIAYALHLEYWTAAGIITILSVQNTTKASFRLVAYRLLATVLGFVIAIGAFLVLGYNALAFGVFLLIFIPLTNVFEVQSGIVMTAVLVTHFMMAKSCSWFWIRNELLLLAVGAGVALVANLFMPSLEAKITEFQAQVEAEMREIIDHMSQQLGPEHLKSADNWANLSDLKMTLDAAVAWANRHSDNQLWSENDYYQAYFEMRANQYELLRQMQDSLDRIETPVLQAAVISDALSMTASVLNEDNPATQLVTMVKKIQRNFAASPLPTDRASFESRARLFYFLEDFSRLLQLKRNFNHIISSQN

SEQ ID NO: 6925 - protein, 66 aa, Lactobacillus casei; identical to SEQ ID NO: 1477

SEQ ID NO: 6926 - protein, 161 aa, Lactobacillus casei
MLKFEEVAPEARIQYLDLLLVGDEDPAMLSRYLSTGTLFAALDDQVPVGVAMVVPVDEQTVELKNLAVASARRRQGIASGLLRHVGLVYATQQYQEILVGTGDVDFDNLRFYMRRGFRLDSIRKHFFDQYSQPVYADGLKLQDMLVLRRKLLLTRENETKE

SEQ ID NO: 6927 - protein, 211 aa, Lactobacillus casei
LAKKRRRFTLKKIPLAAWLVLAFFAVGATLVVGSYWSQRQAEVSQQQASIDKKAAEKAKKEAFIRRLAPTAQAMQKQYGVLTSITLAQAILESNWGTSTLAKDYHNLFGIKGTDPANTKVLRTKEYVNDKWITVDGRFRVYSDDTASIRDHALLFVNGTDWNPQQYATVRAAKDYKSAASALQTDGYATDPDYPQKLIHLIETWNLTQYDS

SEQ ID NO: 6928 - protein, 193 aa, Lactobacillus casei
VVKLLEDRIKKDGQVIGTDVLKVDNFLNHQVDPDLMADLGKEFYRRFSNEPITKILTVESSGIAPAIATAMEFHKPLVFARKHKSLTLKDHLYTATVYSFTKKTSNEIAISRKFLSADDNVLIIDDFLANGQAVEGLMEIIAQAGATLSGVGIVIEKTFQKGRKLLDDKHVRVESLARISAFEDGHVIFAPED

SEQ ID NO: 6929 - protein, 442 aa, Lactobacillus casei
MKSKSISNPKAAALGLQHLLAMYSGSVLVPILIGASLHFTSEQMTYLVSIDIFMCGIATALQVFGNKYFGIKLPVVLGCAVQAVAPLIMIGQKFNFQTMYGAIIVAGLFVFLIGGAFSKLRFLFPPLVTGSLITVIGLSLIPVAFQNLGGGSTTAKDFGNMTNLLVGTFTVLLILAINVWGRGFLHSIAILVGLIAGTVLAGFFGLVSFQPVVEASWFHVPTPFYFGVPHFEWSSIVTMILISMTSMVESTGVFFALGDIVGRKIEADDLKRGYRAEGLAVMLGGLFNTFPYTTFSQNVGLVQLSGIKTRKPVIYSAIFLVILGLLPKIGALATIIPAPVLGGAMLVMFGMVAVQGIRMLQQVDFENDKNLLVAAISIGLGLGVTVQPHIVQFLPKTIQLLFGSGILMTSLSAVLLNWIFNSPSRTLEMPIDRGLNENDSDK

SEQ ID NO: 6930 - protein, 369 aa, Lactobacillus casei
VTQFISPGATIGIIGGGVSAFRMADTASLMGMRTVVLAPTQTDIALEKADIPLVGKSDDRTALKELTQMSTVMTFTDENVDGAILAELATASQLPSGSDILTVTQDRYLEKVFLDDLNMNILPYTQVITPGDINEAIDTIGYPALLKPIQKGMGVDQQLLLSTPDDVDRAKQLLQQRPYILEAYLQNIKEVAVMVAKAGTTIRIGPVIQNYFDHHQLKASSVRADVDPAVIVEIRRIAEKIAKKLDYTGIFSLEFFLATNGTLYVKRVYPGPKLYGHLMQSTSDISEYELHLRAILGWPLPELELAEDGVGIPLRQKDMDAVLTQIQIKPDWRFAFYPNGGELVGEIEIVGDLKAIKDSINATGHFVIQ

SEQ ID NO: 6931 - protein, 431 aa, Lactobacillus casei
VIPRYSRPEMAAIWSEKNRYAAWLEVEILAAEAWSKLGEIPASDVKALRANAKFDVDRIHEIEAVTHHDVVAFTRDVSESLGPEKKWVHFGLTSTDVVDTAQGYLLKQANQILRSDLDALKASLAKLAKAHKDTVMMGRTHGVHAEPTTFGLVVATWYSELNRDIRRFEDAANDVEAGKISGAVGTFANTPPAVEAYVTKQLGIRAQEISTQVLPRDLHAHYIQTLGLIATSVERFALQIRHMQRTEVHEVEEHFNKGQKGSSAMPHKRNPIGSENVSGLARVIRGYETPALEDVLLWHERDISHSSAERIMLPDATGLLDYILHRFTSILDHLDVFPERMKANMNLTHGLIYSQRVMLKLIESGLSREQAYDLVQPKTAVAWDEHRDFRPLLEADPEIMGRLSRADLDDAFDYHYHLKHVDEIFKRVGLA

SEQ ID NO: 6932 - protein, 189 aa, Lactobacillus casei
MLFRSKQLDVYRENLAKLFAPKTIQYLYVPDEEALNDLRDQYIKNFASGGLMKQLAFISSRDTGILDYLSVRNNLYINGHSKNTDFLPEWLNNNSPILDQPAATLDTMQRLYLQFYRGLVGKKRYLLLSGRAEVFDPQVTRSFLTEASRALQQTDSCLLVLTTDQSLLSANPQNAWEQPPVLSLNAIAK

SEQ ID NO: 6933 - protein, 248 aa, Lactobacillus casei
MHFFERTFSGFRYHRRYYIVMMLLSVAFCLISIMLMTSEMIDQSAQGAFLQRLNSFGDQNKEAILLSTQVGQAHIKMVQSAQSLVNRVMIFNAICWLIGTAWLWYHRRSETDALYLVGKSSMSIGLQYAFEAFFSFWISFMITVFLIILFNDQLIQFLTSANRSVFGHLLQEGYQSVDMNRAFRQLFARHLTGFTRETLFYYGGRTDEITQPTGFLTTLGNGMAVIFITTLGLVTPLSMIRKRRVMPR

SEQ ID NO: 6934 - protein, 752 aa, Lactobacillus casei
LKRLRLNRLLLWLRNTRIGFLALLLFLLWAKTLFGYFFDFSLGLNDPLQYTLLILNPLGTGIILLSLGLYPKHARRGYLVGIIVYILSNLLLLANVLYYREFTDFLTVTTILGVSKVSQGLGASSLSMVKPHDIIYVLDIALVALTYLGYSIWNIWRYIHNQPLKWPHFGLSLDTSRMPYHLPQAVTVFGVAFFALLTATSEMNRPQLLTRTFDRNYIVKYLGLAPFTVYDAAKTAQNNQVRAQADSANLDPVLQYTRSHYAAPNASYYGAAKGKNVIIIHLESFQQFLIGQKIDGQEVTPFLNSLIKEKDTLSFNNFFHQVGLGKTSDAENMLETSTFGIANGSLFSSLGTENTFEGAPAILKQRAGYTSAVFHGGSASFWNRDNVYKSLGYDDYFSGNFYNHDEKAATEYGIKDKLMLAETPKYLEHLQQPFYTKIITTSNHNPFYITQADSDFPDAGTDDATINGYFKTAHYLDEALREFFNYLKASGLEKNSLVMLYGDHFGISNDRNTTLAPLLGKDPSKWTAFDNAQLQRVPLIFHMPGLKGGINNTYGGEIDVLPTLLHLLGISSKRYVQFGTDLLSSQHDDVVAFRNHNFVTPKYTVLGSKVYDNTTGKLVTMTPTLQAAITKDQKSVDTRLSLSDDVANRNLLRFYVPLGFKPVNPGQYDYNQSLSKVLSLEHSRGSKSTSLYSKNNDQSTTNLYQTDAPELADDTQPITDFPEKVQAQTDSSASESESSSSETVDIRTKQIK

SEQ ID NO: 6935 - protein, 201 aa, Lactobacillus casei
MLFLGPFYNWINSTSLSRVNHFPLVRLVVYSLDKTILYLLIFAALRCFWLLTTHRRTSFGHELKLGLFVGYLILLFALTVFRDVYYPWQLTFHWDRPLSVINLQPLVETLKLRQAASHFDLWYQSLGNVAWFMPLGFGIPWISTHRRRLGSAIAIGLVTSLSIETLQFLLISGVADIDDVIFNLIGAILGYGFYRMWHLHR

SEQ ID NO: 6936 - protein, 285 aa, Lactobacillus casei
MVILLALIPMFAWGSIGLVSGKLGGNAYQQTLGMTFGALVFGVGTLLVMHPALDSKTWLLGIISGLFWALGQGQQFQSMKYMGVSMTMPISTGMQLIATTLAGALLFHEWHNGRDVTLGILALALLIIGATLTSRREQNDDVTSASGVSKGIRTLLISTAGYAGYTIIVNAGQLGALAVVMPQSVGMIIGALLMSIGHQPFAKATVKNILTGLLWGTGNVFMLLSMAKVGLAVSYSLSQMGIVISTFGSIYLLGERKTHKEMVWVSWGSALVILGGVVLGIMKAK

SEQ ID NO: 6937 - protein, 446 aa, Lactobacillus casei
MSYIKFDSSKLDKFVHANELEQMQPLVTAADKELREGTGAGKEFRGFLDLPVNYDKDEFARIKAAAKKIQGNSQVFVAIGIGGSYLGARMAVDFLSQTFRNLDPDLKFPEVYFAGNSISGTYLADLLDIIGDRDFSINVISKSGTTTEPSIAFRILKAKLIEKYGKEGAKERIYATTDRAKGALKQEADAEGYEEFVVPDDVGGRFSVMSAVGLLPIAVAGGDIDEMMRGLGDGRKAYASADLKENEAYQYAALRNILYRKGYTTELLENYEPTLQYLGEWWKQLMGESEGKDQKGIYPSSANFSTDLHSLGQYIQEGLRNLMETVVWVEEPNRDLTIPDDAQNLDGLGYLAGKKMSFVNRKAYEGVVLAHTDGGVPVMTVSIPKQDAYTLGYLIYFFEAAVSISGYLNGINPFNQPGVEAYKKNMFALLGRPGYEDMTKELNARL

SEQ ID NO: 6938 - protein, 220 aa, Lactobacillus casei
VLVSFMSKQSLIDVAQVALNGSTYELKGTEILNVYKDNDNWVFEIKNDKKIIKSFFIVPKSGGGFLDISALERVNSQAESMFREDSLYGIKDRPGLDRIVNSIFNGFGGEEFYPGVLRKATAYWYKLATTQMFYNGNKRTALLAALEMLVSNGYVLNNLSGKELYDITLAIAAKELSKESLWEYVLKNSSLQYFNTRSEALNSDRWVQLNFKVDENADLD

SEQ ID NO: 6939 - protein, 57 aa, Lactobacillus casei
METKFVIHDANGIIKSTLKDANQKSLRKINTTQIDANLNELLKNPQIKLAVERLAQS

SEQ ID NO: 6940 - protein, 282 aa, Lactobacillus casei
MSVSSIQNSIISLQRDLNRLNEKLTHSRQKSAKEAAKVASASEKLGRGNLSSSRISSLNKDIINGQSAQAKEAKNQASISKELQRKNEKLGVLQTQLSKEMQAEQNKSAAKIQRDYQNQLNQLRNQQISILNEQLSSANDAEQVQRKYDVFISYAHSDSGYVTRLREDLEEADIKVWIDSDEIVWGSSLVESINKGFQNSRFTILVLSKDYFTRFWTQQELRAAFVKESKRKDETILPIYLNITADEVSDYNFSLGDIMAMNAAIVPNKDIVSAIKRALKKI

SEQ ID NO: 6941 - protein, 210 aa, Lactobacillus casei
MKKVSLLVAVITLGIPTTAVAETTLPTNYAVVQASKKKKASKTKVSAKQATTNKKLAKYLKTTKNAGYLVQTVKTVSGVPTIIVNDVTSLNKPVFYEYMAQIIGNAKKTPMTFKGIGIVQQNEYRNASGKKKNLMEFSFFFNSNTLNQLSFSSWGQIVYKNPKSFYNEATGYYLMSDFVKDSKNRRPNSNLMKADDGNIIASYMDKFGTD

SEQ ID NO: 6942 - protein, 95 aa, Lactobacillus casei
MKVINVTLKVKPELTDKYRHFISLLVEGSRAEAGNLSYDHFQSLTDPNKYEIIEHWQDAAAVELHNQTAHFQKFLAGIDDFLAEPLEIVRMDYTE

SEQ ID NO: 6943 - protein, 284 aa, Lactobacillus casei
MMKRKIMKFLTPLVVLGVLLVGCSSESSSKSAKTVADPVASQTKLNKKTASAISSLDDAITDKREQVSKLKTALNKQEPEAKASEAPSSSPDTSNLANLDYTGQQEITVNNNDPAFNKSDLSTAKGAWATYSDLDSQNRVTDANALLNKSLMPSAKREPLTWNPTGWHNKKTARGWLYNRSHLIGYQLTGENNNPKNLMTGTQTLNSPLMLAHEMDIAYYLKQNSQHYVRYEVKPIFRGNELVARGVQMRAQSVGDDTVRFNVYIFNVEPGYTINYADGTSTKN

SEQ ID NO: 6944 - protein, 254 aa, Lactobacillus casei
MSTLGNLFVMLGLIGTVWGTIRLVRQRKHPLTKRFNLIILIGGIVLMFVGSPMVDTQPSTASSAQTTTKKLTAKQKSLLKSEKARGKVLLAAKAKKSSELKALKKEQTKLEDQLDARASSSRAVEESASSAASESASREASASKVAASSAQAASSSQAAAAAAAAKQQAEEAKKSAAQQQQQQQQQQAATTQQQAPPTNQGDMNTGDQGTIVGNSRSKIYHVPGQAGYRMNSANAVYFNTEAEAQAAGYRKALQ

SEQ ID NO: 6945 - protein, 387 aa, Lactobacillus casei
VKPAKTKFNDAPDGSIHQYNQILKYFNDRPADQTKPRGNRITFVSTGIIGYDGGQTTMLHLGTLLADAGYDVYYLSYVPQSQDEMIQNAEFNYPGYKGTCLPMGELESHQSDIWIATLWESVYIIKNKPGYKMYFVQDYEPYFYPYGDRYQMARRTYSLGLHMVTLGPWCAHMITTHCQVNSPIDVINFPVDVARYPFKERDTAPYQKKQQIKLAVYTKWSSPRRAPVTIQIVLENCRHILRARGIDLKIKYFGTGRSKRFINGENLGKLTPPELNQLYHEADFGIATSMTNFSLVPYEMMSAGLPLIDFKEGTGSYFLKDNTYFSCHLDERDLAKTLQAACANPDTITQHIEKAQAYLKTISWERTEKDMLAIIANLYANVDVVKS

SEQ ID NO: 6946 - protein, 305 aa, Lactobacillus casei
MLTIGVMGLGTIAQKAYLPVYAQMQDQVQWLLSTRDEDKLQQLSKQYGLAAAGNSLEALDAKQLDAVMIHTPTETHYQYVKHFLEKGIHVFVDKPLATDMGQVNELYDLADSQHVMLTVGFNRRFAPMIQDLAQVADKTGVRVDKNRIDALDDTKHALWDLFIHPVDTALMLAGYPEKPNTRYALHTTSDGQLQQASVTFTAPGIRGEAGIDLQAGTNLEEAQVASPSGVQRVQNLDQLVVYGRGGASQTFAPNWQPMLETRGFASMVQAFVQAVADPDGKNPVSPATSQLAHAVVADLVNQIQE

SEQ ID NO: 6947 - protein, 155 aa, Lactobacillus casei
MYQKSFMEIANEEARANVNGSDGGPFGCVIVKDGKIVSRAHNQVLVDHDPTAHGEITAIRKAGQALGTHDLSGCELYTSAMPCPMCLSAIIWANIKQVYYGNTADDAAAIGFRDAAIYDFINDGLKGKMLTLSQHDRDMTIGAFKAYQTAQKKLY

SEQ ID NO: 6948 - protein, 45 aa, Lactobacillus casei
MQYRIQLDTKNQLFVAIDAHDQNHFGTGRTIEQAIHNLKATNKAA

SEQ ID NO: 6949 - protein, 397 aa, Lactobacillus casei
MVHEIRLRWLLTGALLSSIGMSFIWPLTSIYLHNRLGISLTVIGIVLLLNSLGSVIGSIVGGRLYDQGDPYRLTLFGVGLTGLVLIGLTFWHGWPAYCIWLTLLGIGSGWNITMVNSLGTSLRSKDGRYVFTMLYFAQNVGVVIGTALVGFVYDISVTLLFLIAVILYSLFFTVVLTKFRPAAKIPQDQPKEVTTTAEKPSLPAANKLMLTTFFFALLVFWLMYQQWSSNLSVYMTSLGIPLRNYSFLWTLNAALIVVIQLFLNWFNEHVNGIRIIYQILFGLVMVAISFLILITARTYSFFVIAMIALTTGEATASPAIPALVNDLTPRAIKGRYQGFVNSWGSVGRALGPLFGGLVIDWLSYRNLFIIAAIGVFTLVAILLSIWLKTRHDLVRYQ

SEQ ID NO: 6950 - protein, 476 aa, Lactobacillus casei
MKIESACTSILVGKKASIDGSTMIARNDDTFSPLTPQRFYMHAGWKGEKSLHVKSPLNGFEADLPENGYRYNAVPNVENDKLGDYEESGINERNVAMSATESTYGNERALGFDPLVKDGLDEDLIVNMVLPFIESARHGVEYLGQLIKQYGSPAGNSVLFSDKDSVWYMEIVTGHHWVAQRIPDDAYAIAANQVAIQQVDFEDTDNFAWSEGIQEFVEDHHLNTDKEGWNFRHIFGTMNEKDRHYNTPRVWYGHKLLNPEIAADPESADLPFIMRTDHLITREDIAQILGSHYNETPFDPYGHGADADRFRYRPIGLNRTQNSHILQLRSDVQEGLAAIMWLAIGMPTFSPYVPFYCNANDTDPSYSKTPKAFDLDADSAYWLHRLLDVLVEAHYPQFIQADRDYLTALNRDYREMLQSFDEGAKELGAKELTQYLTEANYKIVAHTKAATKALINDYVMESLKLSKLTFNMDKNL

SEQ ID NO: 6951 - protein, 57 aa, Lactobacillus casei
MIETSFMLLKMLLGAGEHVMVMLQVADILTFIKAAASMPKSRHKQSKCRHRLKKPQS

SEQ ID NO: 6952 - protein, 61 aa, Lactobacillus casei
LNSAVKAVFTRGLRAVLMAFFLFIARAFLTWPWLAFMIAAFLIYACICFAYAGFLAWTQRL

SEQ ID NO: 6953 - protein, 111 aa, Lactobacillus casei
LIDAAIMILAYAHDHPQSYHVRQVPYQNVASILLDDRVIFPSQQLFFPPNRLRVIRLPEHFSFNNPELSAWLLSLLPELGEDVETPSTNQMWMTTSHLTKAKRLLIEVSFE

SEQ ID NO: 6954 - protein, 238 aa, Lactobacillus casei
MTKRLYLVRHGETPMNAARLLQGITNANLTAKGRDAADRLGELLQPVPFAKAFSSDRTRTLETAKRILAGHEPKPPLVALSALREYYFGGLEGDPGNAIMARTIRRYGLTTAWRAWVGSKRFPGLVRSIRNADPTHQAEDFPDLLARARQAFEQVDAQSPDDSDILVVSHGLLLSALIYQLAPDQLPFSLLKNTSVTRIDIVNQKMHVRGVNLTREQDILALRHDEPETDDAAKNEAK

SEQ ID NO: 6955 - protein, 218 aa, Lactobacillus casei
MPKATFFRLPEAKQQRLMDAAYQEFARAPFNETSISNIIKHAGIPRGSYYQYFDDKADLYFYLLETVRQRTVLTLQQVMTKHHGDLFPAMSEFFGKTITALAHGPHAALYRNVFLHMDFHSAAKMAGSKAPFLKPHHGHQEIHDFLLTSIDRSRLRIQTDDEVSLLIRQIVGMFMQTIAYYYSNQAEGKPITVAELKRRSDQLLDWLQFGVARDKKHH

SEQ ID NO: 6956 - protein, 576 aa, Lactobacillus casei
MLKLAKKRMSGIAVIGAILFMIVQVMSNLYLPNLTADIVNNGVAKGDIDYIWATGMKMILFALLSILASVGNVFLASRTSQKLGQKLRSDIYRKVINYSHDEMDKVGTSSLITRTTNDVTQIQNVWMMILRMMIMAPIMLIGASFLAYQKSHTLTMVFLISLPLLAFFLLIIMYFAVPLFKAMQKKTDNINLVFREGLTGVRVIRAFRQDDFEQNRFEGVNQDYTHNAVKVFSIIAAVFPVMTLIMSGTNIGITWWGGNLIAQQALETGNLIAFMTYAMQILMSFMMLSMIFVFIPRAQASAARLNDVLAQESRITTPASPKTLDIANPDLAFDHVQFRYHHAEEPALRDIDVHVKGGQTMAIIGGTGSGKTTMVNLIPRFYDAEKGAVRVDGEDVKNVDLKKLHEAVAFVPQKANLFTGTVRDNMKYGNENATDENIWHALDIAQARDFIESNPEGLDYQVEQGGGNFSGGQRQRLAIARALVKDASIYVFDDSFSALDFKTDANLRAALKADKKIQTKVVVIVGQRVSTVADADTIVVLDEGKMVGRGTHAELKASNPTYQEIIKSQIREGDEK

SEQ ID NO: 6957 - protein, 628 aa, Lactobacillus casei
MADNQKSATKRPSSGPRMRPGGRAGLVEKPKNFWKTTGRLFGYMRNRLIGIIAVLVLAIASTVFQIRTPKILGEATTEIFKGVMKGQAEQKAGIAVGSYPIDFDKIKHIILIVLILYLGSALFSFLQQFIMTRISQNTVYQLRKDLKYKMKTVPIKYYDTHSNGDIMSRAINDMDNIASTLQQSLTQMVTSAVMFVGTIWMMLTISWKLTLIALVTIPLGLIVVGIVAPKSQRFFAAQQKALGLLNNQVEETYGGQVIIKSFNREDDEVRDFEGQNQAFYDAAWKAQFVSGIIMPLMIFLNNIGYVFVAIMGGIEVSNGTITLGNVQAFLQYMQQFSQPISQLANLANTIQSTIASAERIFAVLDEEDMQDNPSGVPAVPNDPNKLVMDHVQFGYTPDTLLLKDYNLQVKPGQMVAIVGPTGAGKTTIINLLERFYDISGGSIRLNGTDTRDMKREDVRSHFAMVLQDTWLFTGTIWDNLKYGREDATDDEVLAAAKAAHVDNFVRQLPDGYNTILNEEASNISQGQRQLLTIARAFVADPEILILDEATSSVDTRTEIHIQHAMNRLLTDRTSFVVAHRLSTIRDADNIIVMNHGSIVETGNHDELMAKNGFYADLYNSQFSGNVAI

SEQ ID NO: 6958 - protein, 277 aa, Lactobacillus casei
NADPHDEPENDENTFMNREDCTASEMKILGIYGGQDAKGLTASLVKAVLSSVTAPATTEFVDLNQYQIRPDVSDQANPTLDELEAKLKSADVWVLGTPTYFGTVAGQFKQLLDCMRHRMTRMTKEGDTLPGIFKDKHYVSVTSCFATGLDNTFTHQTDATLVAIDKAMTAAGVHKIAELVLPHTWGMTTLPEAKINQAHALGTKLATFKKKDDETLKRYILLFGMIAIMALATMGIQQVLPGVATNFWWRYVSFVVIFFVLLACLLHYATFMRHKRR

SEQ ID NO: 6959 - protein, 288 aa, Lactobacillus casei
MAGIALPEETRVDFIALKVANLAKVSQWYQQVARLDLLRQNGDTIYLGTRLNQQVLVVLHQIKGLSPQKPVTGLDHFAILLPNPGALGAAYRIVKQGQPVTKAFQTGYQQGFLAKDPEGNGVAFTIDRAIEQYQEERQYNWEDETEEAIDPAEIGKHAARDYDRLPSGTTIGYVQFRVADLASTSHYLEDGLGFREKPSPNTGEVFLAAGDYRHHIGINLRLEATLLLPTPDMYGLDYVSFILPDKMAMENILMNLDAAGLTDYDYHHENQFLMIAGPNRLTLWFRVA

SEQ ID NO: 6960 - protein, 337 aa, Lactobacillus casei
MDFQAITAELQAWVTGRIIPGFSVALMTGKDVQSQVSGDAQWQPTPAPLRPGMLYDVASLTKVIGTTTVFLQAWDQKLVAPEMPLKRFLPAFPHATTFRQALTHTSGLEGYIPHRDDLPAPALKRALMTQLAVTDEVDAKVVYRDVNLLLVGWALEQIYHQPIQTLITQQVLRPLGLPKATFQPDPEQCVPTTYDPVAGLRRGVVHDPKSAILGQHSGAAGLFASLADLEMFTQYFFGQKQASAWPDHARQLTRDWTTHQLGRSLGWDLRHDGQGRLWLYHTGYTGTFWLIQPQSQLALIVLTNRVHPQPNREFLGKRDQLVQRFLADQPDTGTAES

SEQ ID NO: 6961 - protein, 450 aa, Lactobacillus casei
VAFSAKASLATAIGRSSYWFLHTFLKGGSSLPGKLANKIDPRVLQALGRDYDVIVVTGTNGKTLTTSLIVKVLKQKYQEVLTNPTGSNMLQGITTAFLAQPKHGHGRGIAVLEVDEANVASVAAQLKPKAFVLTNIFRDQMDRYGEFYTTYQKILDGVTLDPKAVVLANGDAPIFSSRKLPNPVHYYGFTLTDAGDHKAPPNTDGVLCPVCQHILHYHAITYANLGNYFCPNCGFKRPQLKYQVNTVTKMTPQSSDFVIDGQPCHIDIGGTYNIYNALAAFAVGRTFGVSPEQISQAFAYDEKVFGRQEVIQLGDKKLTLILVKNPVGLNQVLSMIETAKQPFGFAMLLNANYADGIDTSWIWDGNFEDFVASKKAATYLVGGERYKDIALRLTVAGVPEAKLMTQPDLSDVITELQKMPQKQLYVLSTYTAMLQLRKKLSEGGYIKAGF

SEQ ID NO: 6962 - protein, 196 aa, Lactobacillus casei
MAQLFFRYGAMNSGKSIEILKVAHNYEEQNKRVILMTSALDDRAGVGMIASRIGFERTAIPVKHETDLYETIKETDPHAACVLIDEAQFLQKHHIFEAARVVDELHIPVMAFGLKNDFRNELFEGSKYLLLYADKIEEMKTICWFCAKKAIMNLRIHDGKPVYEGEQVLIGGNESYYPVCRHHYFHPPLDKIEHQD

SEQ ID NO: 6963 - protein, 359 aa, Lactobacillus casei
MDKIFEQLDGLLDRYDELEELMSDPEVISDTKRYLALSKEEGGMRDVVAAYKRYKQVLSDIKESEEVLRESKDEDMEALAKEDLDDLQKQKANLEDKIKVLMLPKDPNDDKNIIMEIRGAAGGDEASLFAGDLLNMYMHYAERQGWKAEIIDSTPTEVGGYKEVVVMITGDNVYSKLKYENGAHRVQRVPVTESAGRVHTSTATVGVMPEYDEVDLKIDPKDIRTDVYRSSGAGGQHVNKTSSAVRMTHIPTGIVVSMQDERSQQENRARALQILRSRVYDYYETENQEKYDQTRKNAIGTGDRSERIRTYNYPQNRVTDHRIGLTLNKLDRIMNGDLDEIIDALIVHDQAQKMESLNV

SEQ ID NO: 6964 - protein, 276 aa, Lactobacillus casei
MSKTYAEALKWASLLLTEHHVDPDGARYVMMTRANWTPSQLILHRQDVMPDASWQQFQADVARLAKFEPAQYITGVAPFFGAMFKVTPAVLIPRFETEELVDWVAKEQTAARTGLDLGTGSGAIGITLARQLPQVAMTLSDVSEAALAVAEQNAQAQHVQARFVTSDLFSHLLGRFDFVVSNLPYIAPEETPVMDQSTLRYEPKLALFADHHGLALFERFVAALPAHLNDHGAAYLEFGYRQQPALQKLFAEKVPQAQVTFRQDMAGHPRMAKLQF

SEQ ID NO: 6965 - protein, 340 aa, Lactobacillus casei
LSKRYHESDIPEAAAALKRGELVAFPTETVYGLGADATNVDAVGKVYAAKGRPSDNPLIVTVADAAMVGQYATITPAAAKLMATFWPGPLTMILNILPGRLSMKVTGSLQTAAFRNPDNALTRKLIATAGVPIVGPSANTSGKPSPTTADHVLHDLAGKIAGVLDDGPTRVGVESTIVDLTVTPPAILRPGAIGPDELEPILGPVDSAIHHVGKNEAPKAPGMKYKHYAPSAQVVVVDDPGQFPEAVEWAKKTGQTFGILATDPILAKFSAVPGYSLGQDIKSATHDLFAGLRWFDLHPDVTLVLAQAFSHSELSMAYMNRLLKSAGNVHYQPNMPTDSF

SEQ ID NO: 6966 - protein, 410 aa, Lactobacillus casei
MDFMAQDPEVFGAIHHEEERQEHNIELIASENIVSPAVRAAQGSVLTNKYSEGYPGHRYYGGNQYIDVVENLAIDRAKKLFGAEFANVQPHSGSQANMAAYRAFLEDGDKVLAMDLTDGGHLTHGSPVSFSGQEYHFYHYGLDAKTERLDYDKIRAQAEQIKPRLIVAGASAYSREIDFKKFREIADHVGAFLMVDMAHIAGLVAGGVHMNPVPYSDVVTTTTHKTLRGPRGGMILAKAEYGKAINSALFPGIQGGPLDHVIAAKAVALGEALKPEFKTYTQQILDNMQAMVAGFEEDPHLRLISGGSDNHMVLIDVTGYGVNGRQVQDLLDEVDITTNKNQIPGEQNGPFKTSGIRVGTAAITTRGFTPEESKRVAELISAAIAHRDDQPALDQIRQEVLALTARHPLS

SEQ ID NO: 6967 - protein, 209 aa, Lactobacillus casei
MGKFTVLNHPLIQHKLTLIRNKHAGTKEFREIANEIAELMVYEITRDLPLESVEIETPMGKTVQKQLSGKKLAVIPILRAGLGMVDGVLRLIPAAKVGHIGMYRDEKTLKPHEYFVKMPPDIDQRDLIIVDPMLATGGSANMAIEALKKRGATSMRLVVLVAAPEGVKAVQAANPDVDIYAAALDDHLNENGYIVPGLGDAGDRLFGTK

SEQ ID NO: 6968 - protein, 236 aa, Lactobacillus casei
VNEQYPSIKLFGLTFNLTNDIGVLVSAVLVFLLVLWLSRNLKMRPGGKQNVLEWAMDFTNGIVKSAMPGSERYTFNLFAFTLFLFIFISNQIGLFIELDIGKDTWFRSPTASPVITMTMAMTVLVLSHYFGVVFRGFKGYIKGYASPVPILLPINLLEEFTNFITLSLRLYGNIFAGEVLVLLIRQWAFSGGALNFVSATVAEIAWQGFSVFIGSIQAYVFVTLGMVYTSHKVLPE

SEQ ID NO: 6969 - protein, 70 aa, Lactobacillus casei
MQFLAASLAAGIAAFGASIGNGMVISKTLEGMARQPEMAGTLRGTMFIGVGLIEAVPILSVVVAFMLMLR

SEQ ID NO: 6970 - protein, 162 aa, Lactobacillus casei
MSLGDTLFTLVTFLILVIAVGKVAWKPVTKMMADRQQKISGDLDYAEKSRKEAETLAAKRREELQHSQADAVKIVNQAKENGEKQRQSLVDAANTEVATLKKNAQADIDQARKDALASAKNDVADLSLTIAQKLIGKELNAADQKDLIDDYIKRLGDANGSH

SEQ ID NO: 6971 - protein, 181 aa, Lactobacillus casei
MAVTNQMVAPRYAKALLEAAHDQDQVATVHEELQALASVFKENPTILTIFDNARITADDKANLMATLTKNASPLVANLLKLTQQYGRFGALPDIITAFNRAYDDEAGIITATVTTAVALSADQADALRSAIAARFGMKSTQLEQIVDPSVIGGVRIQAHGSVIDGTVKHRFEKMKAALLAD

SEQ ID NO: 6972 - protein, 509 aa, Lactobacillus casei
MSIKTEEISSLIKKQLEGYQDDLAAEEVGTVTYIGDGIARATGLENAMANELLQFSNGSYGMALNLETNDVGIIILGDFDEIREGDQVKRTGRIMEVPVGDAMIGRVVNSLGQPVDGLGAIKTDKTRPIEFKAPGVMQRKSVSEPLQTGLKAIDALVPIGRGQRELIIGDRKTGKTSIAIDTILNQKDQNMICVYVAIGQKDSTVRAQVETLKKYGAMDYTIVLTAGPSEPAPMLYIAPYAGAAMGEEFMYNGKHVLIVYDDLSKQATSYRELSLLLRRPPGREAYPGDIFYTHSRLLERAAKLSDKLGGGSMTALPVIETQAGDISAYIPTNVISITDGQIFLQSDLFYAGTRPAIDAGASVSRVGGDAQVKAMKKVAGTLRLDLASFRELEAFTQFGSDLDAATQAKLNRGRRTVEVLKQPVHKPLPVEKQVIILYALTHGFLDPIPIEDIGRFQDELFDFFDSNAADLLKQIKDTGNLPDTDKLDAQIKAFAGGFQTSKQLAAAKG

SEQ ID NO: 6973 - protein, 307 aa, Lactobacillus casei
MAESLMDIKRKIASTKKTGQITQAMQMVSGAKLSQIEKRARKYQLYADKVRQIVTHLAAGQLLELANAANNDAEANKNQLVSVASLLEKRPVKKTGYLVITSDRGLVGSYNSTVLKAMMQMIKDDHEGPDDYVMMAIGGVGADFFKARGLNLAYEYRGVSDIPTFNEVREIVKTAVTMYDNGVFDELYVCYNHHVNTLTSAFRAEKMLPISDLDVSEVEDTNVEYLVEPDLDAVLDAVLPQYAESLIFGAIMDAKTAEHAASTTAMRSATDNANDLISHLSTQFNRARQAAITTEITEIVGGAAALE

SEQ ID NO: 6974 - protein, 488 aa, Lactobacillus casei
MPNATGKIAQVIGPVVDVAFPINDNLPEINNALTITRKDGSQLVLEVALELGDGVMRTIAMDSTDGLQRGMAVQDTGGPISVPVGKDTLGRVFNVLGDPIDGGEAFGPDHRRDSIHRDAPKFEDLNTSSEILETGIKVIDLLEPYLRGGKVGLFGGAGVGKTVLIQELIHNIAEEHGGISVFTGVGERTREGNDLYFEMKESGVLENTAMVFGQMNEPPGARMRVALTGLTIAEYFRDVEGQDVLLFIDNIFRFTQAGSEVSALLGRIPSAVGYQPTLATEMGQLQERITSTKKGSVTSIQAIYVPADDYTDPAPATTFAHLDATTNLERRLTEQGIYPAVDPLESSSSALTPEIVGEEHYKVATEVQRVLQRYRELQDIISILGMDELSDEEKVIVARARRVQFFLSQNFNVAERFTGQPGSYVPVEETVKGFKAILDGKYDDYPEDAFRSVGRIEEVVEKAKKMGFAPDEQDTDADEKPAAQAAAN

SEQ ID NO: 6975 - protein, 143 aa, Lactobacillus casei
LAETSNVLRVNIVTPDGLVYDHHAKMLVVHSVAGELGIMANHEPIVTPLAIGEVDVQRVDSSDHNDSIAVNGGFMEVSDNVASIVADSAERERDIDLSRAQAARDRAKKRIEQAKNENNQDDLRRAQVALRRAINRINVKTSH

SEQ ID NO: 6976 - protein, 78 aa, Lactobacillus casei
MFQEIGLNAAITLVSHFVFIMLAFRALNALRFERFIKANHVREAQVLLLFMAVGLGYLVSSFFLSLVQAALNLPKLFL

SEQ ID NO: 6977 - protein, 329 aa, Lactobacillus casei
MAKDIGIDLGTANVLINVKGKGIVLNEPSVVAIDTHTGKVLAVGTEAYKMVGRTPGNIRSIRPLKDGVIADFDITEAMLEYFINKLNVKGVFSKPNILICAPTNITDIEQKAIIQVAEKSGGRHVYLEFEPKVAAVGAGLDIFQPQGNMVIDIGGGTSDIAVLSLGEIVTSRSLRLAGDKMDSSIAAYVKNKHKLIIGEHTAEQIKIKIGAVYDADPKETIEVRGRDIATGLPREVSVTSEEVSDALHETMMAIIDGAKGVLEKTPPELSADIIDRGIMLTGGGALLKGISQLFAAELKVPVLLADDPLDAVALGTGVLLDNIEHHRQY

SEQ ID NO: 6978 - protein, 56 aa, Lactobacillus casei
MDPEYPKRIFHHIKIWLIIAAIALILGLLIGFGMGGSNPFKVFLPSTWIHFFNFLR

SEQ ID NO: 6979 - protein, 101 aa, Lactobacillus casei
MKQILTWLVRGYQRFISPLLPPSCRYYPTCSTYMIQALQRHGAIKGTLMGIARILRCNPFVKGGLDPVPAYFTLRRNPHPENDLDLSDIQNLNHKLGGHHG

SEQ ID NO: 6980 - protein, 73 aa, Lactobacillus casei
MAKERNIKVTQTDETRNGHTVSVLKIGDQEIGFIEPDGTRFAAYVAGSDKPNRFKSMDDAVNALIAEYHLHQG

SEQ ID NO: 6981 - protein, 401 aa, Lactobacillus casei
VESHEIKSNSEGDRIDYGIILSVMLLALIGLVSIYLAASHDGSTSQNPVRATIMQAAWYAIGGIGIFFVMRFDAEQLWRIAPYLYGIGIFLMIAVLIFYDRATELNTGAKSWFALGPISFQPSEIMKPAYILMLSRVVTQHNAAYSHTIQNDWKLIGRMVLWTLPIAVLMKLQNDFGTTLVFLAIFAGVTLVAGINWRILLPIALGAAALGTLAILLVTQSWGRSFLGSIGFKTYQFARIDSWLNPSGSTSGDSYQLWQSMKAIGSGQLTGKGPFHMAVAVPVRESDMIFSVIGEAFGFVGAAVLILLYFMLIYQMIRVTFDTKNEFYAYISTGVIMMILFHVFENIGMNIGLLPLTGIPLPFISQGGSFLLANMLSVGMVLSMRYHHTSYMFSRDTEDFE

SEQ ID NO: 6982 - protein, 99 aa, Lactobacillus casei
MATTYFWQDELAAGQVRLGLTQDAQETLGKIKFVDLPQVGTSLTMGNPFLSVEAEKAVLDLEAPLAGTVVDVHQELSDKPALLDETDHNHNWVVTVSAK

SEQ ID NO: 6983 - protein, 374 aa, Lactobacillus casei
MTDPVALLQKLIRIDSANGHELAVAKVLQAEFEAAGIPTKLIPYKDDRVNLVAELNQDGRVLGFTGHQDVVSPGDESAWTYPPFSGKIVNHVMYGRGTDDMKSGLAAMTLALIALKQAGFKHHIRFMATVGEEFGAMGARQLTEQGYADDLAGLIVGEPTDKLLQYAHGGTVNYEIDSEGVSVHSSRPEKGVNAIDGLVAFAEREPTAFDQAPDDPDLGVFRHSITVINGGDQVNTIPAHAYLRGNLRPTPAANIDLVVDLLKQLVDQANQATSAKLTLKVLHRFLPVHSDKNGHLVTTANQAIAAVTGTPAKLAVAYGGTDASEFIRSDNHFDVIVYGPGDNHFSHQVDEHVDLDSYTTAIKTYQEMAKRFFN

SEQ ID NO: 6984 - protein, 274 aa, Lactobacillus casei
MKRFWKIFATIAVLGLILVGCGNSNSSSSQKQTTVKIGVVGADNRVLQSVAKKVKKQGINIKIVQFSDYNQPNTALKDHDIDLNLFQHQYFLNNWNKTHHGDLVSIGQTIIAPLAIYSKKITKISQIKQGDTIALPNDPTNEGRALQLLQAAGLIKLNTKVALPTTRDVTANKLNLKLKAVDAAQTASSLPDVAASVINSGVAQDAKLNPKKAIYTEKVNKQSQPWINVFVANKKDKNNRTYQKIVKAFRTKDTANLIEKLYHGSEVPAWTQKF

SEQ ID NO: 6985 - protein, 276 aa, Lactobacillus casei
MKSWKRAIITLALVLPLFVLAACGKSSSSTSKNTTVKVGIMSTDKEIWTDIQSRLKKQGVTIKLVQFTDYNQPNQALEDGDIQLNAFQHHNFLDNWNKKHNTKIVDIGATYIGPMRAYSNKIKSLKEVKAGDKISLPNDPSNEGRALQLLAQNGLLTLKKGVASPTIRDITENKLNLKFTELDAAQTARSLDDVAVAVVNNDIAAAANLKPANAIAVEKITKQSKPWVNFIAAKSAKDKNNATYKKIVKAYQTKRTAELLKKVYKGSTLPAWNYKF

SEQ ID NO: 6986 - protein, 350 aa, Lactobacillus casei
MSDQAVVTLKDVDVEFHGKTRSVHAVDHVNLTVNRGDIYGIVGYSGAGKSTLVRTINLLQRPTSGSVNVLGQDMLALSAAQLRKERKRIGMIFQHFNLMNSRTIADNVAFPLKGIKSKQEIKKKVAELLDLVGLTDRANSYPAQLSGGQKQRVGIARALASDPEILISDEATSALDPKTTSSILDLLKSLNERLGLTIVLITHQMEAVKQICNRVAVMDAGAIIERGDLLQVFSDPKQQLTKDFIDTTLQLDQAIESVLQQPAVKNLGPNDRLLRLTYVGASADQPLVAKLFESYHVTANILFGDIQILQDTPFGNLIVVLSGDQAQVDAGIQYLKQQDVKIEDILKKEA

SEQ ID NO: 6987 - protein, 229 aa, Lactobacillus casei
MVQFFTKYFPNVVPIWSGDGGVTQAINETLYMTALTAIVAGVLGIIIGILLVLTDEGGLLANHPFYFVLDKLVNIFRAVPFIILLAIMTPVTRAIVGTGIGPTAALVPLIAGTTPFYARQVQNALLTVDPGVIEAAEAMGVSPLGIVWRVYLREGLSELIRVSVLTIISVIGLTAMAGAVGGGGLGNLAIAVGYQRYQYDVIIVSLIFILALVFLVQFIGDFFARKSHH

SEQ ID NO: 6988 - protein, 255 aa, Lactobacillus casei
VHTLEIKDLHVKIKAEPEHPEILTGVNLKLATGEIHAIMGPNGTGKSTLAETIMGNPAYEVTQGDILIDGKSILDLAVDERARAGLFLGMQYPQEIAGVTNAEFIRAAINARRPEDDQIRITDFLKQLDKTMATLEMPESMADRYLNQGFSGGEKKRNEILQLMMIHPHFGLLDEIDSGLDIDALRIVAKGVNLMRGPEFGSMIITHYQRLLDYIIPDVVHVMKGGRIIESGGPDLAKELEKTGYEHLKVGEQNG

SEQ ID NO: 6989 - protein, 352 aa, Lactobacillus casei
MNTLKWVNKMVETTTLPAPNLPKFPLARYLKNQPDAVEDRVVLHAPQAIAYAAGSSEVQRFTPTNSLDAWLLRSPQGATTVDIPAHFVSGDDPIVLTGPKNAGGLLYVHVGKGAKVTLQEKWASSGHVLGIWLMLVVDDDADVNWLSYDSFTADTVLVNRTATLAANAKLNWTLAGFSHNSGLNRVDVRLLGQNAEATVNVGVLASGNQHVSYTTSVTNEGQHTVGHINQRGVITGNAHLMFNGIGHIIKGARGSDAQQENRVLMLSQRAEGDANPILLIDENDVTAGHAASVTRVNADQLYYLMSRGLSATLAKRLVIRGFLEGGLAEIDDVRLKKELFATIDRTLVAEDA

SEQ ID NO: 6990 - protein, 398 aa, Lactobacillus casei
MREQFPFFKAHPDLVYLDTAATSQKPQALLDSLQNYYINDNANVHRGLYKLAYDTTEAYEGVRQQVADFLHAQSAEEIIFTRGTTDSLNLVASAFGPQAVPAGGRIVVSGAEHHSNFIPWQQLAKRQQATFTVTPVHPDGTVDAPALLAAITPGTNLVAIAQVTNVAGDTLPVAEIARKAHDVGAIVVVDGAQAVAHMPVDVQALGADFYAFSGHKIYGPTGIGALYGRADLLAKMPPIQFGGEMISEVRDQESTWADGPIKYEAGTPHIAGVIGMGAALHWFQENVDAAALQTEHELTSQLRTALTAIPDLTVYGNDDSLATVSFNLTGIHPHDVATFLDEQQIAVRAGHHCAQPLMARLGVPATVRASFGVYNNQDDVTKLVEAVQAARRYFHGID

SEQ ID NO: 6991 - protein, 148 aa, Lactobacillus casei
MALTKLDQMYRAVILDEAQHPRHHGVLADFDHEITVRNPSCGDVLHLQISEKDGRINDVAFSGSGCTISQASASLMTDQILGKTPAEIEQMVETFSDLIIKGDVPDADRLGDAAVLKGVHQFPARIKCATLAWKAAAQVLTQKGKTDD

SEQ ID NO: 6992 - protein, 478 aa, Lactobacillus casei
MTETKNTKNNETVAADIDFLPDENPADFKDDIKPVYSTGRGLTEETVRAISAEKHEPEWMLDYRLKAYATYRKLAMPNFGPDLSDLDLDNMLYFQKATDRTYRDWDDVPDTIKKTFDRLGVPQAERKYLAGASAQYESEVVYHNMRNEFEKLGIIFMDMDSALKEYPELVHEYFGKLVKPSDNKFAALNGAVWSGGSFIYVPKGVQTDVPIQSYFRINAENTGQFERTLIIVEPGAHVNYVEGCTAPNYSSDSLHAAVVEVFVKNDAYCRYTTIQNWSKNVFSLETKRAQALDNATMEWVDGNLGSKTTMKYPSVYLDGKGAHGTMLSIAVAGEGVDQDNGARMIHNAPNTSSSIVSKSIAKDGGAVDYRGTVRFTKKADNAFCHVECDTILMDEKSSSDTIPYNEIHNSTVSMEHEAKVSKVSEEQLYYLMSRGISEAKATEMIIMGFVEPFTKELPMEYAVELNRLIGMEMDGSVG

SEQ ID NO: 6993 - protein, 60 aa, Lactobacillus casei
MDNYDKARKVLQSMALSKIAQETGISIGQIWHYRDRHEGIEKAPPAYVERIARLYRKKRV

SEQ ID NO: 6994 - protein, 126 aa, Lactobacillus casei
MAEDLEHFIKTMALGIPTIKPDEKRAFLGNFRERVAMAVTIRQLRDARITAMLDSVLTRYPGYRIFLNGRMGESLVNQYMLQALAHQYPFTIMNQPGMRVTKRVLPTDFGWVLAHPTQKISRPILL

SEQ ID NO: 6995 - protein, 322 aa, Lactobacillus casei
LTQLDTIQTTVQQLRTLLNQGKIFATLPDMLGKVIDSIATESKTRVTIPRDDKTAIARIRTIQKRIKQTSDPSVTDDEIAFLVAHLASTKPAVRDKGVFFLFNDLFQAEAFTNEQVKALFKRLQAPDILFSHIFEPQNDAVFLRSFAVMILSGMIYADQNRYHILSKADYLTTVQNIGTYILLERDGRGYVETKGWAHAFTHIGNMLEELSQVDVLPRSEKVFLMAAVVEAWRRIETPLIFGEDHRMALYLSGITNVNQFYSETLLMCLKNWQHTLVNIRPQESYAFWVRWYNRNRLLQALTLRADLPQPITDYIQQIVDLF

SEQ ID NO: 6996 - protein, 62 aa, Lactobacillus casei
MKKVTMSKLAYYNICLFIFNHKYFYCSGLQKLLQLIGHTNQLHPAFSKIKKYTNLLLKDGVC

SEQ ID NO: 6997 - protein, 295 aa, Lactobacillus casei
VRKEQQTLRILGDKVRYYRKLKGLSQAELAANICTQATISLIEKRNKVPSMNILMRLISRLGIQLDDIVVEHHDRIQQLLNAIDYQIQHHQYAVAADNLSKIRLDKIKSEDDQKRYYYYQGIIELFKNNAPDEAIYFFGRVLSPLVNSERDLYAILATLGLGLAYADKHTFDRSRVYIDQALRMLKHVPLSDSKYLDVELTIYWHIARVYYELSDFKAVLKYTDHGIREAVKHDKLFLLDELYTLQARALKLLGNPEAPKSYQIAIAFAQVTGSTALAASLAAEMVTQKPNSETA

SEQ ID NO: 6998 - protein, 166 aa, Lactobacillus casei
MLQQYQHILVAIDGSYEAELAFKKAVAVAKRNQAELILIHIVDTRAFQNVSSFDSAMVEQVTENAKSTMEGYVDQAKKAGLDKVSFSIEYGAPKTIIARDIPKAKNIDLIMIGATGLNAVERLLIGSVTEYVTRNALCDVLVVRTDLTNKPALASTKKPTEQHQDD

SEQ ID NO: 6999 - protein, 92 aa, Lactobacillus casei
LTIILMCIYAVALFGLAAYTWLHRYQNFLIIKKPSPGMTRFLKNFAYLFTLVGILAIIGGILFPMWANLVILVSGAFLATVFVFISLTQMKL

SEQ ID NO: 7000 - protein, 431 aa, Lactobacillus casei
LQQPLAYRMRPQNLDEVVGQEDLVGPGRIIRRMVSAHRLSSMILYGPPGTGKTSIASAIAGSTKYAFRILNAATDTKKDLQIVAEEAKMSGTVILLLDEIHRLDKTKQDFLLPLLESGRIILIGATTENPYMNIQPAIRSRTQIFQVKPLTADDISTAIDRALADEKRGLGKYQVDLQPEARDYLTHATNGDLRAALNGLELAVLSTPADHDGTITIDLTTIQQSLQKPSLAGDVNGDAHYDIISAFQKSIRGSDVNAALHYLAQLIAIGDLNSITRRLLVIAYEDIGLANPATASRTLTAIQSAERLGLPEGRIPLADAVIDLCLAPKSNSGIKAIDAALADVESGHAGQIPDDLRDAHYRGAKQLGHGQGYKLPHNYPNGWVAQQYLPDNLKHQQYYHPKTTGRYEAALAQRQQQLEEWQRDAEKLRKK

SEQ ID NO: 7001 - protein, 653 aa, Lactobacillus casei
VNHYWQLIQKQHLSDLATQTRLGVVRTVKPVLPEGAQLAAWPQLSRHALVQPLSASTLQVVTPLLDDFAGVIAELRAGLSRIWANLPEDGRLPVFSEERVNQQVVRIVLPETLFERLYTAENFQGQGPDYVAYRNEVYDLVANGLMRQLPLLTDLFAATPLSGHQAFWPSSDQERQLVQKVTDPDHLDRTLALDVMVELDPYTASGITSQMLTFLRDSCWFALSQPAIPVAVASEVRRHALEEARKIAAMEPATPVKELTATMDAMATWLNHMGMTAQQKQAFELMQTRLMKPETTVAGQVAAAFGEKNAAAKSLSEEARTDLAGTDGLPGMIDLSGNTQALVQAAIDGGYQFTLLDRQQGLVQIATDTQTQVIVDGTITKYTPGNALLIATHRHAAKKLLAAAGIPVARGAKFTRWSDAKSAFERSFAHKSIVVKPEARSQGVAVEQFAVPPTEKQFASAFHEANRYHGVLIEMMARGTTYHFTIVSQQVLSVLETAAANVVGDGRKAIKELVALKNGTRPAARQLQLDAAALRQLKLQSVTPETVLRRGQQIFLATAAHPQTGGDLYDVMDEIDPSYKKLAVEAAAALDLPVAAVDIVIDNLYAAYDPDVAGQAVVISVNPAPDLTSPQQPDMGTPRFIAPKLLNWLFAEK

SEQ ID NO: 7002 - protein, 148 aa, Lactobacillus casei
MSDDNMQEHLNSALYGPPQTNPDERRRFMGSLRERVALRVSNQELADPKRQHQVAPLLKDFHDHGYKALLNGKLDNAITGPYMKMLTDANIPFTLVANETAQTDDTAAGLLIVSDKAINQSTIDLPPLDQDQDKTKPKKRGFDLFKHL

SEQ ID NO: 7003 - protein, 187 aa, Lactobacillus casei
MALIRARLDPKFAEAAKTIVPLLQATNHPIFTHIAKHQRRHKNPPPNTWVAFSTSRRGYKMLPHLELGFWDDRLFLWLACLRESKMVPQLLAGVAPLVKKMPGQWLIADDHTAKAAVALSPTALTKKIARFETVKNAEFLIGQVYLADDPIWTTPDVLWTEIQGRVAELAPILDQLVQNVAAYQAKK

SEQ ID NO: 7004 - protein, 221 aa, Lactobacillus casei
MPDIRFHSVFDIIGPVMVGPSSSHTAGAARIGKVVHDIFGEKPEVITIYLYESFAKTYRGHGTDVALVAGLLGMAPDDPRLPESLKLAYDQGIKVSFVPKSDKVDHPNTAHIVLQAGDHRLAVTGVSIGGGNIQITEINGFKISLSMGQPTYITIHDDVPGMIAKVTGIFSNAGINIGTMTVTRTAKGKQAIMIIEADDYQADILAKLKLLPHMRNVTYFE

SEQ ID NO: 7005 - protein, 289 aa, Lactobacillus casei
MFYTVKELVEQSHAFPSVAALMVHTEVENSTRTEEQIRHLMSRNLEVMERSVKEGIAGVKSVTGLTGGEAKKLNTYITDQQFMSGQPIMEAVRNAIAVNEVNAKMGLICATPTAGSAGVLAGVLLAMRDRLHLSHDQQLDFLFTAGAFGLVIANNAGIAGAEGGCQEEVGSASAMAAAALVTANGGTAEQAATAVAITLQNMMGLVCDPVAGLVEVPCVKRNALGASQAMISADMALAGCISVIPADEVIEAVNRVGMQLPATLRETGEGGLATTPTGLRLKKKIFGKA

SEQ ID NO: 7006 - protein, 228 aa, Lactobacillus casei
VINLYLVRHGETAGNVRQLIQGVTNSRLDAHGRKQAFALGLGLKASGLKFDRVVSSDLIRAQETAQQILLGMDEKQPIETNSGLREENDGIFEGRELKDVSEEVFGVSDYHQLVTSGKVPLETIPDRFHAADVTNQAENTQQIVSRYDLALRRIVAAAEAAHETSILVVSHGTASLLWLLAHGADLPNRTELTNASVSKVTYQNGRFKVDWVDNTTFRDQGLQEAWSQ

SEQ ID NO: 7007 - protein, 278 aa, Lactobacillus casei
MKMAPEVYLAKLTNLLLAPGTRTFEREQLLRAKQQVEAGQTVGASWDQLKASLRPLAIRDNLTPDLADFYRTQTGDAEAASETDVSAHFQRDLAYQDRAIFAGGCFWCMVEPFVDKPGVESVVSGYTGGHVDHPTYEQVISDTTGHVEAVEIIFDTRKMSYQQLVDLYFQLTDPTDALGQFQDRGGHYRPVIFVRNDDQRRIAEEAKAKLAASGRYLRPIVTAIEPAATFWLAENYHQDFYKKNPKRYRMVEKTRQQFLKFQHAQGDLRMLLKRRKRA

SEQ ID NO: 7008 - protein, 311 aa, Lactobacillus casei
MQAPKRHWTERDIPDLTGRYAVVTGGTSGVGFAMSAALLRHGATVIIIGKNRLKGQAAVETLKQQTQRQVIRFIAADLSDQTAVNQLADELLATLPRLDILINNAGVMMPAERTVTRDGVELMWAVNYFAGFILTLRLASLLAKTPNARVVNVASIAMGRPHLTFNQFDGRDYRPWTFYANSKLAQAMMAVKLNQLFHEAGQSVMVNGSSPGLAATSLKTIQSRATAWPMRLAALSFRIMPLLRQSPQRAALPALYAATDAHAQGGVVYAPASWHGLRGYPGLWSWNSRPELHDQDLLNRLYRASRQVTGV

SEQ ID NO: 7009 - protein, 321 aa, Lactobacillus casei
LKQDIFQAWSKHKNILDFLKSRVNHDENGFIYVAHVVVDATITTNILYMQDLHFKKSCGIIKTFVIIRRNSSLKGSCFVQTSGNYFSWLLHQLKGWPQQNYYLFWFAFGCQLMTLVDAKITAVTVITFIGTTLGVLCVLAINATKAVNGWLGLLSAACFIFVGFTARNYLSMFEQVAYVITLDLPVLISVRTWNDDTKNHLKTFNLQKWVLSIGFTLVVWAVSAYLIGQYTNDPRPIYDGMAFAISLTGGIVCFLRYNNQYFWWLFSGIAQLILWAVTFAQGDASLAMAINSSIYVINDILAFTVSPWFNRGRKQLGLKAL

SEQ ID NO: 7010 - protein, 242 aa, Lactobacillus casei
VIYILGSIGAGKTSLTKVLSEDMEAPAYYEDVEGNGMIANMLQKFYGAGADSRKRTGAMLQIAFLTFRYQQLKKAVTQENAIMDSSLESDFVMASQLHKHGEIDDVDYNVYVTLSQEMQSNVNGSPWNGMPDLAVYLKIDPDHELDEIQNRGRDMEDIRQKPELVDYYRRVNTAYQEWAKGYTRSSMITVDRDRYDFIHSAADRATVLDQIETKLVDLGKLSPKEFDALQAKHAAGPISKFA

SEQ ID NO: 7011 - protein, 270 aa, Lactobacillus casei
VAIYDQHMHTLYSFDSEAQLRDYLAQTKAPVVTTEHLEFDNPDDGGRDDLPDYAGMVRTQAALATNYHNELLLGIEAGYFAPAEPRLRDYLAHHDFDLTLLSFHHDGKHDYLDTQIATLPPKQVLTDYFSRMLTGIQRFHDADVLAHFDYGVRQFEITPEQLEAWGKAALDQIFAIAVDHDLALELNTKSMYKWHNASLYDLAITWYQAAGGHLFTIGSDAHEGPHYEANFAQALAMLKRHGVKEIATYRHHKRTMVPIEPPVIDADNAY

SEQ ID NO: 7012 - protein, 546 aa, Lactobacillus casei
LKTQQKWLVMMTAALTLVLAACGQSSAKTSSSASKQQVWHRMESDVLQTLDPSKASEGVSGQAIIDTMNGLYKYEGHDLQPAMATKIVKPTNNGLTYTFKLRNAKWSDGSPVTAQDFVFAWQRTVNPATKSSQANMYSGIQNADDIRAGKKPASTLGVKALNDKTLEVTLEHPIPYFNSLLNNVAFFPQPAKQVQKWGDKYGTKSAYTLSNGAFKSKDWSGTGDKWVEVKNNQYWNKKNVHLTQIDVQVVKDSNTALDLYHTGKLDDATLTGQLAAQQKGKTGYVANKRARTYFLELNENKVPAFKNTKIRQAISMAINRDSFVKNVLADGSIVARGITPADLSQLPNSSTDFATAVAKGTKAVTSYDKKKAQTLWEQGLKETGLKSVSVELLGDDVDAVKATQEYLQGTLQENLPGLKISIASVPAKNRQQRASDRNFDMVLSTWGADYPDPNTYLDLFTSTSEYNHGQWQNSDYDKLMTKANTTDANDPTARFKDMTQAEQLLVNQAGAIPLYQLVAARMVNPKMHDLKTSPGNSFNFVYAYLK

SEQ ID NO: 7013 - protein, 109 aa, Lactobacillus casei
MIKKLQSLHDYVKKNYEAGKYDASANEYKQWTEDYQAAATTSGHADDDSDFDMGYQQAMTDHDHGFSFRNYPEAAIDFGNLVSGNRMHEVADFIKGYNAAKKDIVEKTQ

SEQ ID NO: 7014 - protein, 299 aa, Lactobacillus casei
VELRTLRYLVAIADAGTITAAANKIHISQPALSRQMQELEAELGTKLFQRKRRAISLTANGTYLVNRARQILNLTETAITDITDENIIGGNLAIGLGESHLNRTVLRAVKQLLVAYPSIQLQLYSGNADEIMERLDQGLLDFGVVIDPTDTYKYAFSKINGENLWGLLIPTNDPLASLPGISAPQISGYPLIVSERQSVVEMLQKWAGHHFSESQIVARYNLIYNAGLLAEAGLGYVVGISRLLNQEEMSLKFVPFSPKLATQMALIWTKNTPLSKVAEKFLTFFQQVNEQTSSKKPSH

SEQ ID NO: 7015 - protein, 138 aa, Lactobacillus casei
MNDKDQQAGIFGLGAVNSAYQQYFTGKSYLKSLANASDGVDVYVSNVTFEPGCRNNWHIHHNGFQILLVTSGEGWYQAAGEPARLLRPGDVVTIHEGVKHWHGAAKDSWFSHVAITKGTSEWLEPVSDQAYAQLREVK

SEQ ID NO: 7016 - protein, 105 aa, Lactobacillus casei
MVKQTAGRKQLGEFAPQFAALNDDVLFGEVWSKEDELSVRDRSLITIACLMTSGDFPQLKAHLRMGKEHGITKKEVVAEITHLAFYAGWPKAWSAFALAKEVYGE

SEQ ID NO: 7017 - protein, 94 aa, Lactobacillus casei
MDIEQKDEKIANIFKVLGEPHRIEILRILYHAGRELTCSEVSAQLNLSKSTVSYHFRAMRLAGLTHTRQVAQTKYLSINEATFDRFLPGFLATL

SEQ ID NO: 7018 - protein, 209 aa, Lactobacillus casei
MLRLFYASGTSAMAPHILLTDAGLDFETEKVNLDRKTWRGGDYNQINSKSYVPTLQISPTKYLTECAVILEFIALKAKSDYRSSEESMAYWQERMWLNYIATELHKNFISPFRRGNWLPNTADSKKLVWQRVVPRLQYVEERLQGPWLMGKRFSMADPYLFVMTNWMRRLGFSFDGLQNLQAFDESMRERPSVQEVLRVEGKPHSVTDV

SEQ ID NO: 7019 - protein, 740 aa, Lactobacillus casei
MIQADYLEQAKEEFLNKFSTVFPNHRHSLKQSQSSLHKLLQEVVEDIQTIASGQYVDNDSKIITLTTTLSSLEKELASSNNRLTAAEKFLADWLDYDNQQSGVLDYLPLIGPRRKAERKASYLHLKGKPANSNPETELDEERKTNERVKAQIDDAQSKLDAINTAKTTFMQACQRYNIDSDSVNGQIDTKLRYLAFLLATHYWEATWLLNVVQPKSETQPNDSFSKLRQQWQLRAMLTPCFVGTFYQVDAFFMDQKTPLFNAIDLLIADESGQVSPELAVASLALAKRFLAVGDTKQIQPIWSIQENVDEANMRNLGGFTESEAKVMKDNGFTVSTGDLMTLAQNQSAFTGDSESDSGLLLREHFRCLPQIMNYFNSLAYNGRLISMRKEPAATTEVHLPQMGYAHLFGHATSRNGSRYNQREADAIASWLSERKNKLLSLYNEHDQLLGKTVAIITPFKEQTIEIKKALTRQHLDEEEIIVGTVHALQGAERRIIIFSPVYDTASNSFFFDRGVNMLNVAVSRAKDSFLYFGNTDILSTNGTAPSSQLARQLFAHEENELRGASYFKASEVTTRLIGADKHDNWLIQHLLRASRQVDINSPYISGRSIKQGAKPLLAAIKRATEQGVQVNIYSSRGMYNKNSPHYIDQMDNFNLGVAFLQESGATVVDSPFRVHSKQVVIDGHILVDGSFNWFSAVRDESSQYYNTDTSTVVDDARLVKEFALPFMLESNVEKRVSKMN

SEQ ID NO: 7020 - protein, 401 aa, Lactobacillus casei
MIDRKKLANYYLESLRQSVLISGNAAKSPHLDIAYEEFREGHVAASKMNSLNASIVKKLKTQDSLDILITPVVIPVYNRVIFPIIIPATINASGQLEHEEYATPWIPRDLMSPVIEDSTVSSLYRPIADVSQYFEGIKGGAFNDLSWTDYVKQTEILFKDLTGKRISDFNTLEYTSGQQFHASMPKICRINLGGQITGMSFWIQRLYQVIIETKRSLPLLDSLNPEISSDQKDVSLSKSEIQTHYSHHLGQMTPKYGITATQRDALAYFDATSDGKTLAVSGPPGTGKTTLIQSVVATEWIKAAVKQTMPPICVASSVNNQAVTNIIRSFKSNTSDDSNLDSFYLPNTSTYQGARSNKAILASHWLPKHNTTRMVFISFPPTSLRRVAKNLRPFLEIILTT

SEQ ID NO: 7021 - protein, 202 aa, Lactobacillus casei
MITLYLAEDQSMLNSALTQLLDLEDDLHVLGSSGDGATAWQDIQQLKPDVAILDIEMPKLTGLDVADKIHESDLPTKVIILTTFAQKAYFERAVAAKVNGYLLKDSPSDDLIAVIRKVMTGQTIYAPELVTNMVTAESNPLTDRELAVLAEVASGLSSKQIAASLFLSEGTVRNYLSAIFSKLGVHNRIEAVEVAKRNKWLA

SEQ ID NO: 7022 - protein, 372 aa, Lactobacillus casei
VKHNLRSWLMNLEWTSYIWLVYLPYIMAQYVPTKSVTDWIWLGLGVVFLVVYILVNEIDRWLPVTIPLELAITGLFAIFAFNDYMIIYPGWQVSFILARYPRKYFHWFATAFYLIILVGLWRANLVHPGTLNISNGNLLNLVFPLVSPIFAYTASRSIIRQRQLRQTNRRLQAIVRRGERERIARDLHDTLGQSFSMMTLKAELAKKLLDKAPERVGPELDDIAQTSRHDLQLVRSIVNDLHQQSLSEMMLTQGKNLAEANVVLLTDGENAATEWPTKVQIHLSPVISEAITNVIRHAHAHQVEITFEQTPSAYIVNIQDDGRSKNNYARAGSNGISGMQQRMNDVNGTFTITHTRQGTLVTLTLPKEQQVS

SEQ ID NO: 7023 - protein, 254 aa, Lactobacillus casei
MKTFLAQVAFDGKRLVLRNFSFIFFSLLMPAGFYLLYTKVMISGSAVEIKQFNISYMDQMIVFSILLEALFSIASILKRDRDKGFTTFLRLSPKGMVPYYVSITFWMLMMSLLSVIVLGGIAIGVNNVSLDASQWLGFLGIILVGQLPILMIGIALSHIRREEMLSLASNLLTFPMAIISGLWWPISLLPKWLQTIGKETPTYFVNNLLNQVTSRATVDLTNLVGIAVWFVLGSLLVVVMTKHEQRKGVALGEA

SEQ ID NO: 7024 - protein, 296 aa, Lactobacillus casei
MTTIIQTEHLKFNYDKKQVLKDINLTVHAGEIIGLIGVNGAGKTTLLNILLGLLSGKGAVSVFDKKPGNPNSKARIGSMLQGDMIIPGITVGDMLKLAAEQTEHALDPDSLLADLNLTQLKTQRLGNLSGGQLRRVTFAVALIGQPYLLFLDEPTVGMDANARKAFWDQVEQLRQQGKTIVITSHYLEEIQQIADRLLILQNGRFTFDGTLQQLQKQHLGATITCETDLQPAIFSGLADVDHVHSMGDKLVIHSRNGDQTLKALVPMLDRLHQISLNRESLEDIFLQLTKQEVPQS

SEQ ID NO: 7025 - protein, 498 aa, Lactobacillus casei
MAAALSAPLRQLLLATQLGLSVHHPLAGWFVLTILYRDAGSSSEPITLSYLARKYNNDYLDTSGGETPIADDVLKKVLDVLVTQAGLVEMNPRKVRARMHNGSYHIIQSYVYRITSSGSEYLKMMQKVIDAETTITANTNRIQEYVDLVKKLSAPVRSAADTQLYNDFKNMLDAFDDVMKGIHKLEDDLDELANDIAFNHGSQAASHLQQMLRHQAIPAYREVLNQASRIQGLVNDPTFVDQIAHSLQGSDDMNAAKVVGREDMLVMRLQRAKQWAQAQMTRLALSMSPTATAIDSSLDSIYLVFNTLLGIVHLLSQEFKHAKRQTIDIKALSKKLDGLLAHYQQLHIPAQVPRHLPADREVEDPSDLLDASTMGPVSYLANPTRKQPASETDNPDVTDDAPTEQAQVAGLREFRQTLMVDDRHGRVDHDLTLQTVTARDEIIKLFAATYHEDLNGFAPFGRPAKAVDALPNTPPLQLQVAGEDYAVVLPCGFKFTFA

SEQ ID NO: 7026 - protein, 339 aa, Lactobacillus casei
MARITKLDQLAINELLDHGVFTTTPLPAATQISRAAISELKKPSVQQKLSYYFKNMFGATPENFQENLFLMIGKEELSPEVVHVLLATVKTIINEPELQSNLEDRAIPTQKIVRQVHSEVTELDERELLRCIDALFVKRFGLFTPDRLEEGTENVPAEIDDYWEIHPNFNEFAQNLVDFLKNDQTQPVLSEVQKVNRVLLTEQFMSPKTMPQLWPVLVAHKEAIAEQWTRGGRFVLEVGDQYALLLDQQRQPSVAKPYLAALVVAHQLGSGVAAADLTGLIKTVTAELFPGFTIQPSQVKAALLENDLMRAQDDYWVPTPIVARFAVTQDEESKEGAKS

SEQ ID NO: 7027 - protein, 1040 aa, Lactobacillus casei
LTQQLVPVSYHLRNFNKYAKLDMQAAENGNLTLIGENAVGKTTLANCFFPMLIDGAITTPSFNPAKNTEKVSQSASVRNSSRDTRTFESMLLGWGPGAMKVRTGYSYVLMRSDQRQVILGLGATRVQDDPRKPTWWFIVIAPNPTDALELHTTDAEGKSLDKNQFKAANAGLGDQLHVFDRPEDYREFAATRIYGFSDGKVLGRLANAYRLLASPTLTSGNEKFAPILAALKDAQEGIDDMVIRRVADSQRQVNTYRGLLKRISEGQRRLKQMKSRIFWHNLNHLQEILLTPYSQRFARNSANQEKLTHTQQEVQAYSAQLADLNQAVTEITEQVEQLRNEKAKQDQLIKRRAQYEEQIEGNQRVLDDYRKTQQKVATLQQQLATLAIKHDRIKQQLADHTQTNLSPIRVKLLALTSTLNNFSQVMQADDWQEIEAELGHYIHQVSAAKVQYDGIEETINRLSADVGITKQMQAKMGTAIDTRVQGFGSGRVHDGLQEDNRTIHEAGAAQMNTQYQLLRDQQSAILKKQPDLTVILKDPTILSQLKDLRKQLKPLVQTLLRIQSLLTANESEQKAHQGKLDTLLDTLDPGFDADELAQTIARLKAEQAALKIDPELPKRLAAAVNKQRKLTQQLQSVETEIATRQGVISTLTGTIKTDTAQLAKEAADAAGKLKTLRPYFPEGVHLTDMDELLAFATSNRAKIRSSSYSDISAQIGNLIHRHDGHGEDQNALDALFADRGFPAEASAMRQQRSVADNGLTVVAFDVNKALKLLDDDHAAVEKALAEEQSGNDMAYTTFVQAATAAISAQYNVITTYNQILAAGAGHQHIKLKVRLTPIKGIAPEAIEEACDPQRQQRPHLEALVKQRLDQLANNTEVSNDDEAFFAAARELLDTREWSDFEVLIRRRQSGENDFEVVDDKFVQSGGSGAEKAQAMVLPLLLVPKMVLQRSNRADAPHLVMFDEFADKLDPETAKSFAKTIVNFGFSFIATMPSGAQNKLLADGVDNIVWDVMASPQQGDGRFHLNRVQQNFIWKKDTDND

SEQ ID NO: 7028 - protein, 270 aa, Lactobacillus casei
MSRYSDAFESQTGQAAPEKAAQLDQLFDQIARGKALPPRGQQAVALGLTAHTLNDPHEDPPLFAYYRWVMTHCFQSGQVNELTARLIGMAFTSANIFATDLPQPLTLNPWQLKPMLDFPLKNTRAVVIENNGVFALLNQEYPDWPLILQSGNDFNDVYVQLIQRLEDRGMRYAYLGDLDSKGVQMADQFARLLKQTAAKDVAALQTPKDVRIWLADMGKKDPHRTRQLKVVMPVYQAEMTTIRLFGKFVEQEQLMGIYEKRIGQWLDAGK

SEQ ID NO: 7029 - protein, 246 aa, Lactobacillus casei
MKSGLGSGLTRESKVPGLIDGRCLQIGETMVAYTIKNYQSEMLESWLRCRALAYMRSSFQDEITAEKENVSDATGVSLVAIKDQQVIGIAEAIFLNQGQAKAASYGLHEGTVLTTLDTIAVHPDYQRVGIAKALLKQLRSRLKMRGGILLIYTLDDDAANGLYQTIGAKLCYRASIVHGHSSKNHVPEWTHFRVTDDKQVAVYDEHDQEIAYGQDMETYYVGKSENIKQLTDVHKVVTENVYILEL

SEQ ID NO: 7030 - protein, 118 aa, Lactobacillus casei
MPLNPDNALLWGWIHPLHDEVQYRGLNDRRAASVQLIVDIPSQLVLASDFDAWHIPLGHGNFSDDLSGNDHDWEKLFDEHWLLTNGWEPQSKNAYVQCVFPYIKREWIRNIKYFRGIY

SEQ ID NO: 7031 - protein, 393 aa, Lactobacillus casei
LIKTHKIKLYPNATMRRELERLFNYRRFAWNQALETWNAMYDASLVMADKTLRPNERKVRDELVWNKADWQYEQSARVLQLAVNDLGKAWKNYFNPKMPNHDKPNWKSKKRSRKTFKTDRAQLVNGKLRLDKPHGAGAWYDIKLAEQPRWQGKLKQVCVVQDADGYYASFSIEVQTSVEKKPGLMVTGVDANIGKFDYQTSTGYATQPTLPERLPPLYARIAHYQRQLARKRKVNSKRFNSAAYRTTRAKLKRQYQRVERIQTDLLQKFTTMLVTDYDLIGIEDLDNHHMRMNKRLAKNLHRSLFGKFKVIMQYKADWYGNTLVLADRFYPSTQRCSRCGYVKTADERITLSGNLKHHTGHDDYHCYQCGVKLRRDENAVENLIAYAKSKVTG

SEQ ID NO: 7032 - protein, 170 aa, Lactobacillus casei
MTREKLKKLGSDERFTFQATYADIGMKRTTRGKINTRFLPTILFERVMLGDQEVTDHLWLNYTKQFAELGLLTKGEIVQFNARVHRYKKGYAAVKVIDYGLQRPTKVSIIKSLTDNRAKLPPLPDEKNALIGLVMKTNKDTYLKNGRGFDQWYVDQYNAWLRTESNSTEY

SEQ ID NO: 7033 - protein, 724 aa, Lactobacillus casei
LIEEQTVQLMQQDLTNITHHQISAVLNLMQEGNTVPFIARYRKEMTGSLDEVQIQAIEEAYKHVTALQDRKEAVIKSIAEQGKLTPELERQIHASTKLQDVEDIYLPYKQKRQTKATIAKERGLEPFARWLLSFPTGSLNDEAQKYVDADKELASVQDVLDGAHEILAETFSEIAAIRNWVRNFTMRTGTIRTTVKTKGKDLDEKGVYQQFYDFEETIKKMTPTRTLAINRGEKEKILTVKVLVDPASVMQYFHFKIIDNRPDSEATAFIEDAYQDAYKRFVGPAIEREVRGTLTVDAEEKSIKVFGQNLYNLLMQAPIKGKVVLGFDPAYRTGCKLAVVDENGKFLDKAVIYPHKPAPEKKREAAAPELIALLEKYQVTMIAIGNGTASRESEQFVSETLKQIKRDIYYVIVNEAGASVYSASQEARDEFPDLQVEQRSAISIARRLQDPLAELVKIDPESIGVGQYQHDLPSKELANEVDAVVERAVNRVGVNLNTASYQLLTRISGLSKTIALNIVHYRDENGRYNSRTELKKVPRLGPKSFEQSVGFLRIIGGKQPLDNTDIHPESYPVAKKILAAAGLSEADLGDQQAVAKVSNVDLAPFVNEGVGAETLKDIVASLQNPGRDLRDNMAAPILRKDVLTMADLKPGMKLEGTVRNVVDFGAFVDIGVKHDGLVHVSKMAHRFVRDPKTVVAIGDIVEVWIESVDLARERIQLSMVGPEK

SEQ ID NO: 7034 - protein, 249 aa, Lactobacillus casei
MRPIIALTGDSMVAPSPVINLNYADMAPNMIKNAIVKVGGAPLILPYPEDDAASEALAQQYVAVFDGLVLPGGPDVDPTFYHEEPIQAMGRATYQKDRFEIALIKATLEAKKPIFAICRGIQILNVALGGTLYQDLPSQNPKVTIRHSQAAPGQWPTHHVAITPGSHLASLMGTSSYVNSRHHQAVKEVAPDLKVTAQAPDGVVEAVESKDSDLILGVQWHPENMWPSFPDQLPLFSDIVKRAGGEAHE

SEQ ID NO: 7035 - protein, 434 aa, Lactobacillus casei
MNNSIVKKEQMGYWSMILLGINGIIGSGIFLLPNQAAKLMGSASIFVLLFDALLVITIALCFAQAATYFDRDGGPYLYAKDAFGDFVGFEVGFVTWAIRIIAEATMAVAFTTALVGTFPSLNQPVIKDAVISVMVIGLALMNIAGVRVSTVVNNIISVSKLVPLVLFVAIGIFFIKGSNFTPLFPGGSYKSGSFGQAAVVMFYAFTGFEGLVVAAGDMKNAKRNLPKAVATVMTVVALFYILIQVVSTGILGSALANTDTPIQTAFAKVAGGFGNALVAAGTLLSTGGLLVASSFITPRSGVALAENHMMPQLLAKRNRVNSPYVAIIVSATITLIIAYSGTFGYLAQISAVSRFAQYIPTCLAVIVFAHTKTKDKSSTFHLPLGPVIPAVAILVSLWLLVQVQVSQLVIGLGALVIAVPFYFLTYTYREHGKS

SEQ ID NO: 7036 - protein, 122 aa, Lactobacillus casei
MAQDLHTQMLKGILQGCVLIILSRGEYYGYTLSQELEKYGFAEISKGTIYPLLMALEKKGLITSQLRSSPDGPPRKYYQVTSDGMVACHDFIQQWHQLSQHVTQLLTAEEGVSHDDQGRPTR

SEQ ID NO: 7037 - protein, 279 aa, Lactobacillus casei
MTTKEDQLVEENNQLRTQLTPGNKHYYEDLLVYMRTGAVLKDSTAIEQELLTILTDILAAQKDGVTAVEYFGKQPKETADDILAEVPISWFKSFKMVGYVLITYFLVTTIPALMMPTQPWDIGEELLVGIYFTFVALGIVTYIGHTTYKRNQQWGRWRIFLLWLACCALIAPGFLLPLFLKTPWQLDLSGVSGVVLIAILLIALGFAFWRQADKTMWLPFVPIIGIMAVLGIATRVPAWQPFLLKSTVGRIGLASVLILGIIVFNVLIWLTVRKMKRDD

SEQ ID NO: 7038 - protein, 242 aa, Lactobacillus casei
MRIRKIAIALTLLLGTIVLSGCSHSNRTSNSTNKITTNQSLPDNRTVVNSIMHSPKLQIFFQAPIPLDKDSRPGSVYLIKNDRVAELTVQSDPHDANGRNLPSITFGEIARLKTTDKILQRLRKSYGDSWRDADTSKVGKFTYSQKVKYALDTNHTNNKTKSITLIYHFSEDPAPSDNAHYISFYFPAQNQQLYSTHFAGYVSDEQGGETIMTIVPNSKTFYSLDKKDKKRFIVNPNYQNYK

SEQ ID NO: 7039 - protein, 317 aa, Lactobacillus casei
MKTIRTLALLVSMTIPLTLSACSSNQKSTQSVSHSSTAASTTRSSNSPSSASKASSKSLHPEYLADAIQVKGTSDHASAVLNDQSVAKKMIDLKGKSLGLTSDQIDKFSKKIAPQIRIFAESGDSYDQIETAMDAFYGDYGDVDSSLKSKFEALEKYAQQFKGTIKRDDDTSRPLFNINNTISNVQQGDAYLLTLTHNGKEVAQKRYVVGTIPTGKKIDVATILKGHMLSDPTVGWKVDDTAVQMIASDLDITTESNGSKFDSLDVQLILDSAVKKHDASKVTVDLDQFAQDLNKKRPLDSPYVFTGNGIITIPFQG

SEQ ID NO: 7040 - protein, 163 aa, Lactobacillus casei
MIKENQLRQQLVRFKFHDSKGGLSLSSVQNALAANASAAQLPVAFATDELKTGGLFGSSESCLLMYHPEHPNDYFYYVFKMEKQAAFAFVTAYQAGQSAIFDKGARRENHIVDVFSGTGSSHSDFLEGLTRKGIKFLSGDKEKRKQAERDYYALVASEIIEKM

SEQ ID NO: 7041 - protein, 226 aa, Lactobacillus casei
MKKMKRIWHFSGQLKFRQYITIPSLALALIAITLVLTDLGNVYSDFRDMFIMSFASSVQSLSVSIPHLIFSLLIALVLYTDCRFYPFVRLKTDKLLADDSRPINPMRDDELPYATRTTTKVTAEVDKDMFGNVKWERNFFDDVKRDSHGIPIPKITANATSHTETFQPGKNANEALGLLGMFIKTLWNFLVMFLSCTFAFVTGWQIIYKMQQAAEKDHQNLSNDNR

SEQ ID NO: 7042 - protein, 1101 aa, Lactobacillus casei
MKNSRKRRRLQVALEKQSHRVSLVHSKHRGWFTLGLTSIGLGIVAVGLAGQTNVVNASSNQQITTQKSTSTTGRVWTLRPVSQIEAQIKASNKTVYDIQWGDTLSTISEALNHTGFTTSVNRLAEINHIANVNLIYAGAKLYLQGSGENATVTTKDAAGNDQTYNLNPAKPAIVTPQQNSTGSNGQSIGNEKTTVTDAALIAGHNHSNTGTSNDKSVPNKNDIDAAIKAAKEEQARLQAEREAAEKAKQEAEAKLTELLNAENGQTLAQLQTKRTAAQAAVDTAKAKVQSTTQALQAAQQAYATAKQAADTATANTASKQTQVDTATAGINSQTSQIQSLQAQLDTINADAQAAKDPATQAKVATLKNALTKAQQGLQTYEQQLSQASQQLSTAKQAETAAQQALANAKNQLDSFNGQVTSANAELQQANTNLAALPQQATAKNSDQAKQLKADLANYDAQLTTLDGQLKTLNDQIQAWQQTIAAVQTKLDQAKEQTTKANTANVAAQANDTTSAGQQAQTTIDHTNANMPKDDHVPVNTDKQVTVKVDEQGHQLSDTTGYKLIKTSAPVKTVQTLANGDTITTYTTTETYHQIQHFTKQVTVNVDENGQTLQSTNGYTKASGDEKTTTKKEVTQNGDVTTVITTTVTWKKATQQPGQRDIYETVNKDEQGNLVTPSDAYHLMTIQPSTKETTDPDGTIVTHHITTNVYHKIQYFTKDVTVNVDENGHTLTSTEGYNRIKDATKTSSRDEVAKNGDTTTVVTTTILWEKPNSNPNHKTVKITVKKDENGDVLVNTDGYHLISRNTSSENTTDNDGNVTTTVTTTEIYHKIQHFYINSPTVINIDEMSGEKLTSTANYIEVDKTTSTQDHTAANGDIYSVTKTVLIWRNKSIVIDPIVAAIKKTDDPMTKAISDQITKDDTQVDIQEAETYTNSELSLRVAKLFNEMVNKEQTRTGHTLTKLNTLPKDNLAMAERAVEVMYDFNHGSPDKQVPGKQYSPGWVNGEPSQTFNTENISQSSIKKSAVVGNLDNLIKEIANAMYQQYITDELPENNDGKVGGHYDNIINSNFDSLVAAVYVVDTGSYYRVSTAVSTGRMGTYMLY

SEQ ID NO: 7043 - protein, 113 aa, Lactobacillus casei
VSLPEQVAQRIRDLRMSKHISQEQLANMAGMDASMLARIENGRRPNIKLATLERIVKALGVNYHEFFTIEDDENPQMHLAASVVLLNNPKLVQSLQNIVDLALDDFRDAEDKQ

SEQ ID NO: 7044 - protein, 203 aa, Lactobacillus casei
MSRYTGPRWKQSRRLGLSLSGTGKELARRPYAPGDHGANNRRKISEYGQQLREKQKLRWMYGLNERQFQNLFLRAGKIKEGTHGDNFMILLETRLDNMVFRLGLASSRPQARQLVNHGHITVDGKRVDIPSYEVQPGQVIGLRERSQNLAIVNDAIENTVSRPAYVTFDDNKKEGSLVRLPERGELEPEVDESLVVEYYNQKL

SEQ ID NO: 7045 - protein, 160 aa, Lactobacillus casei
MTTLDPIIIDQLDGLLTGETNPITALANASALLNDSMTDLNWAGFYLFNTKTGQLDLGPFQGKVACMHIQPGKGVVGTSFQQQSVIRVANVHEFAGHIACDSASNAEIVVPINVDGKTVAIMDIDSPKFDRFSEEDEKILTQFGQTLAAHLDTAALNTVY

SEQ ID NO: 7046 - protein, 567 aa, Lactobacillus casei
MIWFFIIVVIIIVAAGGVWWLQHYFQTRIKNLDEKVEAIDIGALSSQVRSIEQLKLTGDSLATFGKWERAFDQLNDHDLADLQKILLDLEDQVRRFRFDHASKIAKVLEAKIETARHQYELISDALQDIRHDEADNRSKMLRLRDDYQVSRKTILAKSFVFGDAQPALEQRLQQLAQLFQKIDQINNDGDHQTAKAEIKQLAEQMDELKKQVKELPPLVNEQVNEFPGQINEIQHGYRQLTTAHYVFTDDIPGMVADVEAKMKDANATLKSIDVAATAAANAEIEAEIDKMYAIMEKEMQAKKRVDAATPDLRRFIDHALRQNRELQTELEHLDQSYTLNHHEIKTAKNLKMQLDTIDANYTKDTDAIEAGKAVYSDVIGRFDATKEQLTEIEKHQVQINQDVAGLKKGEIVANKQAENFELDMRNIKHEIVRHHLPGLPQDYVDQVKHVTSEIEQLNHDLNQVKIDMDAIAKFLIKIANDIEDLKKATSALIDAAGLTEELMQYANRYKTTVKPVADAVKHATELYLHFDYQQAADTLATALEQTEQGSYQKVEDAYLARKKASLY

SEQ ID NO: 7047 - protein, 385 aa, Lactobacillus casei
MIYFDNSATTKISPDALATYNKVSTDFFGNPSSLHALGTKADEVLQSSRAQIAKLIGAKPDEIYFTSGGTEGDNWVIKGTAMAKREFGRHLITTSIEHPAVMNSMKQLEKLGFEVTYLPVDHRGFIHIDDLKAAIRKDTILVSIMAVNNEIGSMQPIVQAARVLDAYPNIHFHVDAVQAVGKGLDSALQDPRIDFLSFSGHKFHAPRGTGFIYAKEGRMIDPLLTGGGQERDWRSGTENVPAIAAMAKSLRLLLANEDDNVAQQQAVRKRIYDHVSQKPKVTMFSQLTPDFAPHVLCFAIAGVRGETIVHAFEDHAIYISTTSACSSKKGTESSTLAAMHTDPKIATSAIRVSLDEANTLAEADAFNDAFDQIYAKFAKLDKATV

SEQ ID NO: 7048 - protein, 405 aa, Lactobacillus casei
MQYSEIMVRYGELSTKGKNRQAFIGRLNGNVTRALHEFPKLTIRPKRDRMHIELNGEPSDQVMARLSQVFGIQNFSPSIAVEKDMAKVHEVALQLMNETAPKGISYKVNTRRSDHDFALDTNAMNLDLGDFLTDKRPDLVVKMHHPDMILRVEVRREAIYLSTKTIQGAGGLPVGTAGRAALMLSGGIDSPVAGYYALKRGVDIEMVHFFSPPYTSQQALNKAKQLTAKLTPYVGRIYFIEVPFTEIQEDVKAKVPEGYLMTVQRRMMLRLTEAIAKQRGDLAIFNGESVGQVASQTLESMAAINDVTTMPIIRPVATMDKNEIIAEAEKIDTYDLSIMPFEDCCTIFAPPSPKTKPKTDRARYYESKLDVDGLMTRALAGIKVQEIKSSDQFMNQDQDVIAELL

SEQ ID NO: 7049 - protein, 222 aa, Lactobacillus casei
LVVNKQALSQATIKRIPVYYRTVKALQQSGVKRVRSDRLSKMVHIAPATIRRDFSNFGDLGRSGYGYSVDLLAEVFGELLEVHSEEQMLLVGCGNLGRALLTNNFRRNPDLSIVMGFDTDPSLIGTTIAGIPIYNLATLSEKVRPGMHTAIVCVPSSAQAAVISQLEANGITAILTFAPKPVPAQPETTIRYIDLTSELQALLFVDHQNKLTQEQKAPLKQS

SEQ ID NO: 7050 - protein, 918 aa, Lactobacillus casei
MEKREPARYRKREPTRSTNLHIAVLKTWMDRKICEVEPVSDETLAPKYDHKAVEAGRYQEWLDEDVFKPSGDPKAKPYSIVIPPPNVTGKLHMGHAWDTTLQDIVIRQKRMQGFDTLWLPGMDHAGIATQAKVEAKLRKEGISRYDLGREKFVQKVWKWKDEFAKTIHGQWAKMGLSLDYSRERFTLDKGLNEAVRKVFVELYKQGLIYRGEYIVNWDPQARTALSDIEVIHKDDKGAFYHVKYPFADGSGYIEIATTRPETMMGDTAVAVHPGDKRYKDMVGKELILPLANRKIPIIEDAYVDPDFGTGAVKITPAHDPNDFQVGNRHDLKRINTMNDDGTMNENAGKYNGMDRFEARKAMVADLDKEGLLLKVEPIVHSVGHSERTGVQVEARLSTQWFVKMKPLAEAAIKAQQESDKKVTFVPERFEHTYLQWMENIHDWVISRQLWWGHQIPAWYNKHTGEIYVGMEAPKDIENWRQDPDVLDTWFSSALWPFSTMGWPNTDAPDYKRYYPTNTLVTGYDIIPFWVARMIFQGLHFTGERPFQYTLIHGLMRDEQGRKMSKSLGNGIDPMDVIEKYGADALRWFLITGNKPGQDTRFSYKQVEAAWNFINKIWNISRFVMMNLGDLDKPQQPDPSTFDLSDKWLFSQLNETIKQVTDLSERFEFGEMGRTLYNFTWNVFADWYVEMSKEVLYGDDEKAKAAKRVNLAYALDQILRLLHPVMPFVTEKLWLALPHSGKSIVTASYPVENTAFENADATSAMDAIIALIRGVRSIRKEAGAPLKTKVDIIVKLTDPALKPIFDQNFDFIDRFVNSKEFTVGTDVAEPKMAGSAVITGATIFVPLNELVDLDEERAKLTKDAKKLEQEIARIDKKLNNQGFLSKAPEAVVAEQRTKRSDFADQLSSTQQRLEQLQQA

SEQ ID NO: 7051 - protein, 69 aa, Lactobacillus casei
MGLSCETVPNSAIGGQMGLSCEIVLAGRSSRRSTRPSFETQRALLRLKVVPTAFQPHLAGDCSALALTS

SEQ ID NO: 7052 - protein, 428 aa, Lactobacillus casei
MNYSESVAYIHSFPRLAKTGDHRRILTLLHALGDPQKEGHYIHITGTNGKGSTANAIAHVLEASGLKVGLFTSPFIMHFNERMMIDHVPILDDELVQAVAVARAALDDLRTTQPDFNVTEFEFVTALAFWYFRQRRVDVAVIEVGIGGDTDSTNVITPVVSVLTEVALDHQKLLGNTITAIATHKAGIIKPGVPVVTGDLVPDAAAVVAAKTQSTGSQWFRFGRDFTVPKAKLHGWGQRLTYQDEDGSLADLTVPLVGDYQQRNMAIAIKTAKIYAQVTDWPLTARDIRQGLAASRWPARLEKISDSPFIVLDGAHNPDGIKGLVTALHELFSGPVTVIAGILADKDYASMADMLTRAFATVYLVPVPGTPRALPEAGYQRLHEGQLKDSWQAALAASLDNDPEQPIVITGSLYLAAAVRQTLLEGKS

SEQ ID NO: 7053 - protein, 214 aa, Lactobacillus casei
MTTTVIFDLDGTLVDTEAIYLQSNVRAAAELGLKRTEDDFRPLVGSAGPNEAKIIADLVGSENAAWFQEFSTKDVLDRIRNGADFVLPGADEALRTLRAARYRLALATSSAQHYVDVVLAAAGWQDWFDPILTGSDVKAHKPDPEVYQVMKRHLGAGPAIVIEDTHVGVAAAEGAGLPVVMIPGIAQQPDEKATAILSSITELPDWLQKHGTFA

SEQ ID NO: 7054 - protein, 222 aa, Lactobacillus casei
MADATEQPRERLLAHGPAALTDAELLQLIVRAGNQHYPVKEIVSEVLATYPALQGLAEGDGDSLDHIRGLGAAKRASILAGVELGRRVMRRQSVRYGQIKNSEQLGKNMVSRFAGANQESMLILFLDVKNQIITEQTVAIGTVDSALADPRVVFREALKLSATNLIMVHNHPSGDPAPSQADRDTTTRFQLAAALLGMNLLDHLIIGGKAFYSFARDDPDFN

SEQ ID NO: 7055 - protein, 333 aa, Lactobacillus casei
LFGFGSKNIGIDLGTANTLVYVDGKGIVLNEPSVVAKNTQTEEVIAVGEEARDMIGRTPTNIVAIRPMKDGVIADYDTTAAMLKYFMQKALGNGSHPQVMICVPSGVTEVEKRAVIDAAKVAGARDAFVIEEPYAAAIGAGLPVMDPTGSMVVDIGGGTTDVATISLGGIVSSRSIRVAGDKFDEAIINHLRQNFNLLIGERTAEAMKIQIGSASVEKAADIDGMTVRGRDLLSGLPKTIDISATDIASAIHENVLDIITAIKETLEETSPEIAADVIDHGIVLTGGGALLKHLPDVISDETKVPVFIAQDPLDCVAIGTGESLKNIDVLKKR

SEQ ID NO: 7056 - protein, 286 aa, Lactobacillus casei
MQKFFSNKKLIALMIALLVSIGLVAGSIYASNNRNTPPFIQRIANDVVGIGGRLVALPGDFARNGLDDVHSLMDTFQENQHLKQQLDSLAQTKVQVQTLKRENKQLKQQLKLNGTLTDYSQISAAVILRTPSDWRNMVVINQGSAAGVKKGMPVMAGSGLVGRIVEVNRTSSKVEMLSTANKSSDRVAAAVETSEDKEVNGIITGYDEKSGDLVLGELNSEHAIKKGDKVVTSGLGGMTPKGLLIGEVTSVKKDDYGLANTVYLSPAANLNDVTVVTVISRTIKGD

SEQ ID NO: 7057 - protein, 176 aa, Lactobacillus casei
MLNEKHFTGHWWIISILLLLLLIDGSLASVLAQWIMRPSFMGTPQLTLLGLVMVTLLVPEEKYTTWIAALIGLIFDSFYTGILGVNALLFALVIYIVRQIRPYIPHTAVFVGMVYIIALLLYGVANYFVNHFIGYGSSSVVMLIANHLGPGLTVNLILFVIVYGPLHRVLINLAEE

SEQ ID NO: 7058 - protein, 195 aa, Lactobacillus casei
MQIIGTLKTLLGKLYEETPTGEVSYRLETGNRLLTEEQLAQIQSVFADYPRFSINGITSAVVDKDVVADMVTAKMTHRIGGVIRSGQTIDIMGDVLFLGDLHSGATLCASGNVFVMGKVSGVVQAGSQGDTRAVVVGDLEGASQVRIADVIEIVADHYDPLKPVAYLSELHTMTHAKMAELANLRPRLFKQMEAM

SEQ ID NO: 7059 - protein, 265 aa, Lactobacillus casei
MGTALVVTSGKGGVGKTTTSANIGTALALQGKRVVLLDLDIGLRNLDVVMGLSNRIIYDIVDVATGRAKLHQALIKDKRFDDLLYLLPAAQNAEKDAIEPEQVVEIVEQLRPDFDYIILDSPAGIEQGFRNATGAADGAIVVTTPEISAVSDADRVVGLLEQRDMPLKPRLIINRIRQNMLADGRSMDIDEITSHLGLDLLGIIVDDDGVIESSNKGEAIVMDPDDLASKGYRNIARRLLGDSVPLMDIRLKKQGFWSKLFHRHN

SEQ ID NO: 7060 - protein, 218 aa, Lactobacillus casei
MTYIFQILPALLSGVKMTLGIFAITLVGAIPLGLILSVGLIPKPKSILGKAGKSLLEGYVWVFRGTPLLLQLMFIFYGLPIIGIVFDRFSAALVAFILNYAAYFAEIFRGGFGAVDEGQFEASTVLNMTRWQALRYVVIPQVVKIVLPSIGNEVINLVKDSSLVYVIGLGDLLRAGNIASARDVTLLPLVLVGVIYLLLTLILTFLQKRIEAAFSYYR

SEQ ID NO: 7061 - protein, 212 aa, Lactobacillus casei
MLELKNINKSFNGRPVLKNVTVTIEDGKTLAIVGPSGAGKTTLLRIISGLEQADSGTMIWNGEPTTAQAMRKQGIIGVVFQNFELFPNLSVMRNITLAPTLQGVDQQQADATAKKLLDQLALSDQAQAYPYSLSGGQKQRVAIARALALNPQILLYDEPTSALDPLLRENVAEMVNQFKASGMTQVVVTHDMDFAKSVADTTYHVGKGGDGQ

SEQ ID NO: 7062 - protein, 270 aa, Lactobacillus casei
MKRRILLAVMVVLAMAGFIISGCARETVNNSWPRIERTKKVVIGLDDTFVPMGFRQKNGQLAGYDIDLAKAVFKRYGIKADFQTIDWSMKETELKNQTIDLIWNGYSVTPERKEKVAFSDNYLINHQILVTKTKSQIHSLKDMKGKTLGVQTGSSGAFDLDAQPKILKNMIANKTPILYDTFNDAFIDLDAGRIQGILMDEVYARYYIAHKADPSSYHIVNDPFPPEDFAVGMRKSDHVLRGKINAGLKALKADGTIAKLQKKWFGKVEE

SEQ ID NO: 7063 - protein, 477 aa, Lactobacillus casei
MWLGLIFGGLYLVNALIAIVTVFRSHRDISAVWAWLLVLMLLPFVGFIIYFVFGRKLRANRMQDLMTQRLLGINDLVVQQQEALAAGQPLIGTPGSGGVSELVRTLLRADDALVTTHNEVQVLALREAFFKQLFEDIGLATEHIHIEAYTIQPDAVGRQLRDLLIEKAHAGVTVRVLYDTFGSHGLPISFWKGLTDAGGQVERFVATKLGRWNPRINFRNHRKLIVIDGHLAYLGGFNLGKEHHGLPTLRDTQLRIQGKAVAVIQARFLMDWNGTSRKQQVKNVDVLFREPVVTGNTTMQVVAGGPEQQVEAIKLGYLGLINQAKRSIWIESPYFVPDDSLLDALTIAANAGVDVRIMIPKKTNQELMAKASQFYLNQVVANGGQAFLYEEGFLHAKTIVVDGKYVSTGTANFDIRSFKLNFEIAAFIYDHRIGKTFQKLFLADMERAIPYTQKVIDAKKRPARLGEELSRLLAPIL

SEQ ID NO: 7064 - protein, 110 aa, Lactobacillus casei
MVLLALGLPILVWCMVVAAVVYFDFHGGSWFFLLTVVNFWAIFQLTFTKTPNFIWVILFTAMVIALILVIWQVVREYDLIIHRYWRMLTRILSLATTCWWFGGILIYFLG

SEQ ID NO: 7065 - protein, 143 aa, Lactobacillus casei
MLMGEFERSIDAKGRLIIPAKFREQLGASFVLTRGMDGCLFGYPIAEWDKLQAKLATLPLAKKDARTFTRFLFSAATECEIDKQGRINIPKSLFKHAALKKECVLVGVNTRIEVWDAERWQEFADTAEENFDDISENLTDFGL

SEQ ID NO: 7066 - protein, 314 aa, Lactobacillus casei
VMTEFKHETVLLKEATAALAVKPDGIYVDATLGRGGHTRQILKQLTTGRLIAFDQDEAAIAAVTASFGNLPPQLTLVHRNFRELTTALAELNISHVDGILYDLGVSSPQFDDSKRGFSYRFDAPLDMRMDQRQKLDAKTIVNEWPYAELVRIFSRYGEEHFSKQIARRIEQARAEGPITTTFQLVDLIKAGIPAKARRTGGHPAKKVFQAIRIAVNDELSALESSLEQALKLLNVNGRISVITFQSLEDRLVKTMFKEVSSVQDVPRGLPVVPASAQPHYRLVTRKPILPSADELAENHRAHSAKLRVIEKIRN

SEQ ID NO: 7067 - protein, 121 aa, Lactobacillus casei
MLESTARPLVQQPAPKPVHKTVNEPAPQTHIAFSGFEKTLMFACGVLATVVCVVCLFMQNRLSNTQRQYEDLQARIMKQSQATANLKQEIGELSNSERLDAFAKAHGFKIINGNIKRVDNQ

SEQ ID NO: 7068 - protein, 715 aa, Lactobacillus casei
MKLFKSKRSTNAHPARNRKLFGIGLIGFTLLILGGFVLRFSFVATVGEVDSNNLAKQRQKQYRTDTVLQAQRGAILDRTGNVIAEDSNTYTIYAILDKQNKNGDKPDYVTDKAKTAKVLSRYLAISEDKILARLNPTKKHVFQVEFGTPGTKLSLAIKKQIDAEKLPGIHFRETPSRLYPNGVFASHVIGIAQAQDKGSGLTGVMGLEKQFNTVLAGDNGYRRSETDAYGYKLPNAKTKLKTPVNGGTVYTTLDSGLQSYLETLMTDVQTKYEPKGLTAVLMSAKTGKILAASQRPTFDASTGEGLGDMWRDSLVEDNYEPGSVMKIVTLASAIQSGKYHPNEYYQSGSVKLDGGTVNDWRSGGWGSIPLSKAFPLSSNVGMVKIEQEMGAGVWKSYLDKFKFGQKTGITLPGETNGRISFAQPLDQAITSFGQGIEVNVMQMMQAISAVSNDGKMLKPQIVSKVVHKNGKETVYKPEVVGQPISKETAAQVIDAMRHVVNDEDGTGVAYKMPGVDLAVKTGTGQIASAQGGYLTGDSNYIFSVAGIAPASDPKYVLYVTMKQPQKMTEPAETILASIFKPMMQRALDTTANGTVAKDTNTADVPAVTNAALTTAQDTVKKAGFDVATIGTGNKVVQQLPASGTKALRDSRVLLLTNGAMTMPDLTGWSKSDVLKFVQLTGKKFKLVGDGFVVQQSIAKGTLLGDTSGTIEFKQQ

SEQ ID NO: 7069 - protein, 321 aa, Lactobacillus casei
MQLAQMLIPMVSAFAITIMFMPLFIGYMRYKKEGQVIREEGPSWHEKKSGTPTMGGLIFIAAMIISAIWVSLWQHQLTLSVWISLFILVLYGLLGFYDDFEKLVHHRNEGLKAWQKLAGQILGAVIFLIAYFHEGFDHTLWVPVIGNISATWFYVVFVIFWLVGFSNAVNLTDGLDGLVAGQTTISFGTYAIIAAREGRTDVLIICLVTVGAMLGFLMFNHKPAQIFMGDLGSLALGGMLAVVAILLHREWSLLLIGIIYVIETASVILQVASFKLTGKRIFLMSPIHHHFEIKGWSEWRIDLTFWLVGLIASGIYLVFFL

SEQ ID NO: 7070 - protein, 459 aa, Lactobacillus casei
VKNISDYRNKKVLVLGLAKSGVNAARLLHKLGALVTVNDKQKFDNNKDAQELLADGMRVITGRHPVELLDEHFELMVKNPGIPYSNPMVKRAQELGLPIITEPELAYQVSEAEWIGITGTNGKTTTTTLIGLMLNQQRPHHAFDAGNIGIPVSQVAQKAGKDDTIVAELSSFQLCGIKTLHPHIAVLTNIYEAHLDWHGSRANYVAAKMRITMNQTPDDYFIMNWDLPEMHKLAKQSNAQIVPFSRKQAPGARASLIDGWLTFDGDKIMQASEMQIPGLHNIENALAAIAAAKLKGVEDDAIREVLRTFSGVKHRIQYLETLEGRRIYNDSKATNVEAATVALNAFHQPIVWLAGGLDRGLPMDALTPLVKEHVKSMVVFGQTAPLMAKIAKDAGVPVQKTDNVMTAVPLAYEASRPGDVILLSPAAASWDQYPNFEVRGDDFIKAVHQLQQTVESEGN

SEQ ID NO: 7071 - protein, 363 aa, Lactobacillus casei
MRLVISGGGTGGHIYPALALIEALKAEGKLDDVLYVGTEHGLESRIVPATGLKFATLDLQGFKRSLSLSNMTTVRKFIGSLGQAKKLLRDFKPDIVVGTGGYVSGAILFAAARMHIPTVIHESNSVAGVTNKFLSHFVDRVAIVFPEVASAFPAKKVVVTGNPRAQQVAGLKPNDRLKDFGLDPHKRTLLVFGGSRGAPKINEAVLAALPIWGKADFQVLFATGRSHYDTIKKSLPPLPSSIKVVPYIDDMPSILPDIGLLISRAGATTLAEITALGIPAILIPSPNVTHHHQYLNAQSLTKQGAALTITEPELGQDFPQRVVTLMEDDAKRAAMAQASKKLGVPDASDQLIAVMTTLLSKRR

SEQ ID NO: 7072 - protein, 286 aa, Lactobacillus casei
MTLAWLRKKEQQSDPLTPWQQYQARQQQKPRHDRRRKPKLDVELPKIQNLRRRKLIKNLALILLPLLFLLGVFGYFASPLSKVGLVSVQGVTTVPDQQVINATKLSDNDLMLSVLVHKNDIAQRVQKSLPEIKEASLTIKGFNRIIIRTSEYQTIGYVYRNHAYHKILVTGKVLKAGTQTPVDTYPVFSGFTAKELPKMIELLNQFPDAIRHDISEIDASRGDANPNQIALNMSDGYRIIADSRTIAKKIKYYPAIVSQVKKKGVVDLEVGAFWRPYSSGEKSSND

SEQ ID NO: 7073 - protein, 449 aa, Lactobacillus casei
MDNQGIYVGLDIGTTSIKVIVAEAVQGQMNVIGVGSQRSEGVSRGVIVDIDKAVAVIQAAVAQAEDKANIKIDRVVAGIPANMLQIEQVSGMIAVGEENKEISDNDVRSVAAAALVRNLPPERETLSLVPTEFIVDGFDDIKDPRGMLGVRLEMRGIMLTVPKTVIHNTKKAIEKAGLRVGGLVISPLAIGRLALTDGEQDFGTVLIDMGGGQSTAAVIHDRKLKFTSVDQEGGEYITKDISVVLNTSFTDAEKLKREYGNADSLATSEEETFPVTVVGKHEPAMISEKYLSEIIEARVAQIFKRLKKALDAVNALELPGGVVITGGTTALPGVTELAQDIFDCPVKRFIPDDMGLRHPSFTEGLALIKYAAQMTDIEMLVSSVLPTPFMVDGAQTPSSSPSPAPQKQPEQTAASEGQRLVKRKPDKQTDKTKSKEPSALRRFFGNFFE

SEQ ID NO: 7074 - protein, 420 aa, Lactobacillus casei
MDFQMDAQSEKGANIKVIGVGGAGGNAINRMIAEDVKGVEFIAANTDLQALNASNAETKIQLGPKLTRGLGAGSNPEIGQKAAEESEEAIGAALQGADMIFVTAGMGGGSGTGAAPIVAKIAKDQGALTVGVVTRPFTFEGPKRAKNATEGIAQLKEHVDTLVIIANNRLLEIVDKKTPMLEAFHAADNVLRQGVQGISDLITSPGYVNLDFADVKTVMANQGSALMGIGSATGENRTVEATKKAISSPLLEVNISGAKQVLLNITGGPDLSLFEAQDASQIVADAAKDDVNIIFGTSINEELGDEVVVTVIATGIEEEDQRRESSRRPAAQTRGADHDKGNDTYRPAFAGNDQHDDQSAQSDDPFGNWDLRREPSKRQTPSSDDMNNVKKKDFDIFENQTNADDAGSDDQPPFFKRRRQ

SEQ ID NO: 7075 - protein, 152 aa, Lactobacillus casei
MAFGKLGEKFNNFFAMDDDEDDYQDQEDEQTQAAQPEDRNVNHYRSNKVVAMGAPTGKAAKIVVFEPRIYSDAKEIGSHLLNNRAVVINFDRIGADDARRIVDFLTGTVYAINGEIKRIGESIFLVTPANFEIDGSLASTIDSDGLNLSSQH

SEQ ID NO: 7076 - protein, 111 aa, Lactobacillus casei
YGGTFAMILYPRTEINVFNFLYALYRVGDWAIYLYMIMVFVYILISWFPNAQGTAIDRFLERWVDPFLSIFRRFIPAIAGLDLSPILAFFVLSLIKFGWSRLFLILVQLIG

SEQ ID NO: 7077 - protein, 259 aa, Lactobacillus casei
MDAIYQHFRKDEAALIDHFAELVETARTEYRAVLTDFTDPRQRLIADSLISAHDDMKLMHFGGYPHAERQRLIFAPDYYEAQPDDFDIRLLQIVYPEKFAEMHHSTIQGTLLNAGLDRDVFGDIITDGQTWQFFVAAHMEDWVMSNISKIGRVGVHFTDYPLDQAVTPENDWEPIDFSISALRLDTVVAHGFNMSRQRAKILIQGGKVRLNFGETEAPDAEVATSDIISVRGFGRLRLDAILGETKKGKLRVSAAVIHK

SEQ ID NO: 7078 - protein, 261 aa, Lactobacillus casei
MALSPLDIHNKEFSSKMRGYDKDEVNDFLAQIVKDYSSLIKDNEGLKKELADAKEKVRYFTDMKEALNQSIIVAQESAEKVKNSAHQEADLIKQQAQQDAQAILNRAKSDADQKMHQAQAQTEQTLHDAELKRQNISVQTEDLKRQSRVFRQRLQVMLESQLEVVKSPEWKELLSSSPEAPDTTDPSQESLDNSPAGFVNSKGAASGADAYTEIIFPDDQSATSSSANAEATPADSATAESESESSESNSDDSDATTDQNV

SEQ ID NO: 7079 - protein, 928 aa, Lactobacillus casei
VKIKDTLNMGKTTFPMRAGLPKNEPVWQKKWDEDHVYEQRQKLNEGKPTFMLHDGPPFANGNIHMGHALNKISKDIIVRYKSMNGFRAPYVPGWDTHGLPIEQQLAKQGVKRKEMSMTDYRELCRQFAMKEIDKQRTDFKRLGVMGDWEHPYITLHHAYEASEIRVFGAMAKKGYIYHGLKPVYWSWSSESTLAEAEIEYHDDKSPSIYVAFPVVDGKGLLDQDTSLVIWTTTPWTIPANYGIAVNPKFDYVQVQVGDHKYVVAAELLDQVAEEIGWDQPKILKTFKGTAMDKMTAKHPLYDRTSLVMEADHVTLDAGTGLVHTAPGHGEDDYKVGMKYGLPVISVVDAKGYMNENAPGFEGVFYDDANKLITKALTEKGALLKLDFFTHSYPHDWRTKKPVIFRATTQWFASIEAFRDQILKAIDTVDFKPSWGKTRLYNMIRDRGDWVISRQRAWGVPLPIFYAEDGEPIIEEETINHVADLFGKYGSNVWFEREAKDLLPEGYTNPHSPHGQFTKEKDIMDVWFDSGSSHQAVLAQRPELSFPADLYLEGSDQYRGWFNSSLITSVAATGVAPYRGILSQGFTLDGKGRKMSKSLGNTIVPATIEKQFGAEIIRLWVATVDSSSDVRVSVDNFAQTSEAYRKIRNTLRFMVANTGDFDPQKDAIAYDDLGSVDRYLMVRLNQVIAKVKAAYDVYDFATVEKTISSFLVNDLSAFYLDVAKDVVYIEAQNDPKRRSMQTVMYTALLDLTKLLTPILPHTAEEVWPYLKQDTAYAALSDMPDVTHFDDEDQLLDIWSAFMDFRSEVQKALEVARDNKVIGKSMEAAVTVYPSGPVRDMLDDVEANVMQLLITSHFEVAPSDAKAPADAEQFEDMAVVVTHAKGEVCPRCRMVRTDIGTDPKLPELCSRCAAIVEANYPEAVANGFDK

SEQ ID NO: 7080 - protein, 74 aa, Lactobacillus casei
MQGRVKNFNVDKGYGFIEADGQPDIFVHFSAINEPGFKSLTPGELVDFVIVEGPRGPQAANVTVHHEADHSDDQ

SEQ ID NO: 7081 - protein, 301 aa, Lactobacillus casei
MKHSKLLVGLTVALTATLVLTGCGSKSASSSSSASSAPAKQSKILAVGSTALQPLVEQAAKQYQTDNPKAEITVQGGGSGAGLSQVAAGSVTIGNSDIFAQEKKDLKASDLVDHQVAVVAIAPVVNKDAGVKNITTQQLVDIFQGKITNWKDVGGKDQQIVLINRAQGSGTRATFEQFGIKTDKVKTSQEQDSSGTVYQMVSSTPGAISYLAFSAIKDGVQKLALDKVQPTDKNVTTNTWKIWAYEHMYTKGKPNASTAAFINYIQSKNVQKTLVPKLGYIPITKMTVARTYDGKIEEVNK

SEQ ID NO: 7082 - protein, 478 aa, Lactobacillus casei
VKNYIDNQKVQKNRWWIITAIGMFTIMSTLDGSIVNIALPVMSRDLKIPMNQAEWVVSIYLMMICGLLLFFGKLGDSIGKIKVFRIGMVLFLIGSLFAGFNNSLALLLAARIVQATGASMTMANNNGIVTEIFPMNERGRALGLIGSFVSIGAIAGPGIGGLILGQLPWGYIFWINIPIGIVALILGSIVLPKDLPSKRVPIDWSGFISFLGFILTLFMGIFLGQERGFTDPVILALFVIALIALAVFVRIENHKTDPLVSFKLFRNSAFTLSLLSAFFIFVTNFFFNVISPFYLQNARGLSPEKAGYLLMIFPIVQVIVAPVAGSIADRIGPYRITMVGLLFIVGSQVGYALFNLQTSFVFVALMIGLVGFGNGLFQAPNNTVVMSSVAPQDLGIAGGLNALARNLGMVVGISTATTVLFSSMSHTAGRKVTTYLNGRPDVFIAGMHVSFWVATGLCLLALALTGYRMWQIRDVADA

SEQ ID NO: 7083 - protein, 397 aa, Lactobacillus casei
VSDDKQTNLTDDLLADPFSTSSGASDTAPKISEAATAKPKLTPEQEAKAQDLASKIDVTKGETVLNYGADAQKQLGVFSQNMLTKVQSQDTGAVGDALTSLMTRLNEANPDELKAENNNIFRKIFGRVKRSIYEITAKYQKIGAQIDTIANRLETSQQGLLNDNKLLDELYDQNKAYFDALNIYIEAANLKLAELNDKTIPEAAKAAEAANDQMAIQQVNDLRQFASRLEKRAYDLQLARQITIQQAPQIRLIQNTNQALAEKIQASVNTAIPLWKNQVAIALTLLRQKNAVTAQRQVSETTNDLLKKNSEMLKISSIETAKENERGVVDIETLTQTQNDLIDTLKQTLQIQQDGRVKRQNAEKQLVQMEGELKQQLLNYTHGDMNGQNPKDVTPHV

SEQ ID NO: 7084 - protein, 220 aa, Lactobacillus casei
VATSKRIRIWRIILWAAMGAVLGALSGRWAIAVFVGVVFAFARFIGELSRPKPKSTSLPSLDPKMAEHYAASGLSDEEIKLFRKTMAELADQIRTIEALTKEVPKLRALTLNTDLIDLLHAYFEALVQAPQRLTDAGTFVYQQVPNLLDLMQKYAQITHHEVKTADTYETLDKAFETMTGMAGKIRTDYQTFIKDDLDDLDSDVRLAKKHLDPNKMHETE

SEQ ID NO: 7085 - protein, 181 aa, Lactobacillus casei
MEEKPIAQQRVFTGELVAVDELTVKLADDQTAKREIVRAQPAAGILALRRHQAMFVSQFRSTVGQATLEIPAGKIHQGEMPLAAAQRELNEETGLKALNWQPLASYFQSLGFSDATMALFLARELTPADQRLPQDADEFVNSHWLTFDEAQQAVDDGRICDSKTLLALFYWQQQEEQHGRS

SEQ ID NO: 7086 - protein, 86 aa, Lactobacillus casei
MAEVNTRKAYREAQKKKKQEARDREAKRVEVEKEYARQTRDKPEVKAARFDEITFRKVNSLKKRLNWAIGIVFGLIVIVFLVLYFG

SEQ ID NO: 7087 - protein, 236 aa, Lactobacillus casei
LIKVGVICAMEEEIRTLLARQTQQKETVIASQHYFEGKIGDVDVILVQSGIGKVQAAMTAALLLATYKPDVVINTGSAGGIGHGLAIGDVVISSGVAYHDVDATAFGYLPGQLPQQPQIFEAGMSYVTQIQTAAAATGLTPKVGLIVSGDQFINGKEAIARILKTYPQALASEMEGAAVGQVAKEFHTPFVVIRAMSDVADEQSGVDFDKFVIKAGEQSAAMLLQFFAHLQASQHD

SEQ ID NO: 7088 - protein, 387 aa, Lactobacillus casei
MQHIYLDNAATTPMAPEVIQTMTDQMQHDFGNASSTHWFGREAHTVMDKSRKILADSIHAQPGEMVITSGATESNNTAITQTAHARAALGKHIITTAIEHPSVLQPLKALEKEGFRVTYLPVDENGRILLADFDAALDDDTILVTIMMGNNEVGSRMPITEIGERLVDHQAWFHTDATQAYGLLDIDVKTQHIDMLSVSAHKINGPKGIGFLYRDPKVQFPSLLKGGEQELKRRAGTENIAGIAGFATAVELITSEEKAKRQTKYLGFKKQIMNALDDADIPYAINGDIRPDNVNHVFNLWLKGISTYALQTNLDLAGVAVSGGSACTAGSLEPSHVLTAMFGADSPRLGESIRLSFGAQTTQEDIQAFIDTLLPIVQRLTVKQAAQ

SEQ ID NO: 7089 - protein, 113 aa, Lactobacillus casei
MALAPTGSAQGDPKTYRIGSELKRFTLIDLGFVQTKNGNFQLQRSLDPNSPYTTANKLKMTVAKNLDKFQLDVTTGNGLKAINIFKNDRTKENVEQYQYWVNNLIERGVIEPK

SEQ ID NO: 7090 - protein, 756 aa, Lactobacillus casei
MFEHGFIEVHNANQNNLQHVNIKVPKYAISVFVGRSGSGKSSLVFDTIAAESRRELNETFPSFTQQYLPKYGQPDVGSIDHLPVAIVVEQKRIGKNARSTLATYTGIYSLLRLLFSRIGKPFIGYSDTFSFNLPQGMCQTCQGLGYVDDIDVKKLIDPNKSLNEGAITFVSFGPDTWRWRRYAYSGLFDNDKPLRDYTPEEMKLLLYAPQQTLEHAPAKWPRTALYEGVVPRIKRSIIGKKEAEHHKAALAEIVTRKPCPACHGTRLRPEVLTCLINQTNIAQVLKMDLVNVREFLKKIQVPLAQDVIRELLRKIDALIDIGLGYLSLDRPTETLSGGETQRIKIAKFLTSALVDMVYILDEPSVGLHPHDIELIKRALVRLKQKGNTILIVEHNPALIALGDYIVEVGPGAGTTGGHITFTGTYPQLLASQALTGRLLKQRLTFRQPRPAKTTLDLPHIKRHNLKDVHAVIPLGIETVISGVAGSGKSTLVSALRDHLTVPYIDLAQADIGANIRSTPATYLKILDPIRKVFAHANHVGSSWFSYNGSGACPRCKGKGVTITNMAFMDPVVSVCEQCHGRRYNDQALSYTYHGQNIADVLQMPIAKAQTFFAETSEIAKPLRNMARVGLDYLTLGQPLTTLSGGEKQRLKLAVELNRTGEVYLLDEPTAGLHLQDITKLLRLFDDLVDAGNSLIIVEHNLQVISQADWLIDMGPDAGIYGGRILYAGTPEASMQVKQSRTGQALRQYNEAPERRA

SEQ ID NO: 7091 - protein, 376 aa, Lactobacillus casei
MVIVLDNSNTRVVVGMSGGVDSSVTALLLKQQGYDVVGVFMKNWDDTDENGVCTATTDYEDVAKVASEIGIPYYSINFEKEYWDRVFQYFLDEYKAGRTPNPDVMCNKEIKFKAFLDYAEQLNADYIAMGHYAQVKTDEDGVTHMLRGADGNKDQTYFLSQLSQDQLKKSMFPIGHLQKPEVRKIAAAAGLATAKKKDSTGICFIGERNFKQFLSTYLPAQPGKMMTVDGVEMGTHDGLMYYTIGQRQGLGIGGNSQNSEPWFVVGKDLDKNILYVGQGFDNPALMATSLSASNLNWTTGEAPAEGTHMTAKFRYRQRDTGVTIHYHADGTATVDFDEPVRAITPGQAVVFYDGDECLGGGTIDAAYAHTNELQYV

SEQ ID NO: 7092 - protein, 220 aa, Lactobacillus casei
VTKLYFVRHGKTEWNNQGRYQGANGDSPLLPESFEQIKALADYLRGMHFAHAYVSPLKRARVTAQTLIKDLDETIPLTVMPALREFNLGKMEGMTFSDVAKHFPAELHAFRHEPAAYDPRKIHGESFSQLINRAIPAIVATVAMDRSGEANLLYVSHGAALAAVIQSLLGTPLAEIRKDGGLTNSSVTILQADGPSLPFKLIDWNETGFLPEPPKPTDTI

SEQ ID NO: 7093 - protein, 222 aa, Lactobacillus casei
MDSDILTAFNQGKHEEAIRAAVKAIDAAPKDPKRYAMLATMLISLKALDQAGELLAKARNLFPTDIELQYTAGLFAYAQADYPAAAAWFAKCRKDKHLKNDATYMLALSYQQAGQTKKALAFALTAHELAPKQTDAALLAADLLLAAQAFDAAADILKPLLDAKQPQILFTYGMALSAAGKDGSHYLDEAKRLDPKGYDQKASAVADINRFLKLQEGHDGQA

SEQ ID NO: 7094 - protein, 822 aa, Lactobacillus casei
MDRHEDSVTGRVKSIFFQNPTNFFKILLIDITATTITWTEPDIVVTGTFGDIKEDETYTFTGHVIDHPKYGQQFQADNYHVDQPTNKTGLINYLSSDKFPGIGPKTAEKIIGKLGVDAINQILDDPASLEGLGITAAKRKMLVDNLKTNQGMERVIIGLNDYGFTSNMAGRIYQQYQNDALEVIKQNPYQLINDIAGIGFTRADQIAAKLNIAPDSQLRLGGAVMDTLQRLTDGEGDTFVELRTLVTQTLDLLERARNIAVKPDDVGQAIVTLAKDNELVAEDKRIFPKRLYDSEWQIARQLKGLAEAGAKAEEPELPDIEKTLAEVQADTGIAYDDVQKKAIVTALRSPIFLLTGGPGTGKTTVTDGIVRTYARLHDLSLDANQYNSDDPFPIMLAAPTGRAAKRISETTQLPASTIHRLLGLGVDTQDFAPNDLPDGLLIIDEMSMVDTYLFRTLLTALHPGMQIVLVGDKDQLPSVGPGQVFADLLRSGALPQAALTHIHRQDADSSIIPLAHAVNAGKLPDDFTQPQVDRSFLACAPNQVPEVVGQVVKRAAVKQFSIADIQVLAPMYRGTAGIDRLNPMLQNILNPKRSARTKTVHFGDTEYRIGDKILQLVNDPNQNVFNGEIGQIVGITLAKEAPSKTDELTIDFDGNEITYKRSDFSKITLAYATSIHKAQGSEFPMVILPLTLQSRRMLRRNLLYTAITRAKSFLILVGELAAFETAVGEVAVNRHTGLVQRLQQVFDIEGSQTAVEEATVPQPALPQEPTQIDTNGSDSDNEVRPAKTAPHQLTPALAASQKIDPMIGMDGITPQMFMTKEN

SEQ ID NO: 7095 - protein, 405 aa, Lactobacillus casei
MEDNIRKSLVIKPVTPKDLEQFNDLLTYVFQVTQKDLEQSGYEEGELERAKRPVLEKSDVLGWFHKDELVSSLAIYPCTVNIHGTLYQMAGLTGVGTYPEYAGHGLMHDLVKLGLEHMRSHKQWISYLYPYSIPFYRKKGWEIMSDHLTFDVKDTQLPKQVNVPGHVERLEIDDPDVIETYNRFAMKNHGAMIRNQLNWDEYWRWENEEERTAGVYYDADDQPQGYVLYWIADEVFHVKEMIYTNQEARVGLWNFISAHFSMVTHVKGNIYKNEPLHFLLDDGDIYQTIKPYFMARIVDVKAFLAQYPFATETTEPFHFIVSDPLAPWNNGTFGVYWDENQQVHITDRPVGEAITTDIQTLTTMLMSYRRPSYLAQIERLSASKHAIKLLENAVPMEEPYFSDYF

SEQ ID NO: 7096 - protein, 316 aa, Lactobacillus casei
MAAVFYYLIYNPAAGGGAAIPIFKQVKAVLDQRQLPYAIKTSRYPGHTNVITKQIGNFNTHEHPVLLVIGGDGTLNQAINGLIGTRQHDIPVAYVPAGSGNDFARGIGMSEDPMHALEQILQASKPVTIDIGRYHERTRDESGYFVNNIGIGFDAAVVNAANHSDSKQLLNKFHLGKLTYLFHVLGMLLTRRPFPVAVYEKGVRHFFHHAYICTTTNIPYFGGGIRLYKPADPTDGQLDLVIVEWFNIVSWALAMLQLLRGKTPTSKAVHLFHANKLTVETSSLEFGQMDGEEMGTRPFEIDFSVASQRFWIDRSI

SEQ ID NO: 7097 - protein, 560 aa, Lactobacillus casei
MKLNIKNNETAVFAVGGLGEIGKNMYGVQFQDEIIVIDAGIKFPEDDLLGIDYVISDYSYLVQNKDKIKALVITHGHEDHIGGIPYFLKQVPNVPIYAGPLAAALIRGKLEEHGLLRTTKLTEINEDTVLKFKKLSVEFFRTTHSIPDTLGIAVHTPQGIVIQTGDFKFDLTPVGDQPSPNFQKMCRFAEEGVLVLMSDSTNAEIPTFTKSERFVGKSIRHIFDRIDGRIIFATFASNISRIAQAADAAMAHGRKIAVFGRSMETAMVNGRELGYLNIPDDVLIDAHQLNSLPADKVMILCTGSQGEPMAALSRIANGTHRQISIQPGDTVIFSSNPIPGNTVSVNHVINQLSEAGAEVIHGKVNNVHTSGHGGQEDQKLMLRLIKPKFFMACHGEYRMQKIHCELAQQCGVPEKNCFIMENGDVLALTEKSARIAGHFPAGDVYIDGSGVGDIGNAVIRDRRMLSEEGLVVVVATINMQKQAVLAGPDLLSRGFIYMRESGELINQAQRRVYRTIKSTFSNNEKVTEASLKDAIISNLQEFLFDKTERHPVILPMLILL

SEQ ID NO: 7098 - protein, 70 aa, Lactobacillus casei
MIYKVLYQKDKVQNPRRETTQTLYLEAPSAVEARALVEANTPYNIEFIQELSGNFLEYEEKSANFKLTTF

SEQ ID NO: 7099 - protein, 60 aa, Lactobacillus casei
MNHSKGALLPFCGSSGAKYRPFQGDRPCFFMVRYLGGVSLFSEAILSHFLSFCTTEGVQS

SEQ ID NO: 7100 - protein, 77 aa, Lactobacillus casei
MAFSYQLPLQTKTLKQQPLEKALQNAAEELDIASSDPALPPFVITDFFVLDGQLHVDVAFITNQATIEYVRDVNRVA

SEQ ID NO: 7101 - protein, 659 aa, Lactobacillus casei
MKIENIKVTDPFWTKYRTIVKDKLIPYQWSVINDDKAITIEKENAGAYDAVKKSHAVENLKIAAGLAKGHFYGFWFQDSDVYKWLEAVAYTLRYAPDKRLEGIANNVIDIISQAQEPDGYLDTYIQIEAPEHKFTHVSLSHELYVMGHYIEAGVAYYQTTHYRKALDIAKKMGDCIDANFGPEDKKMHGYPGHPEIELALAKLADETGDVKYTRVAKYMIDQRGTRPNNFFEEQLKNVQAKKIEDPYYSDASQSDPEPSYFQNDVPVREMTSVEGHAVRMVYLLTGMAHVARQTGDESLFAASQRLWKDVTRRQMYITGGVGSSAPKGEAFTFDYDLPNDTAYAETCASCAMSFFAKQMRDTYQDADYGDVLERELYNGTISGMSLDGKHFFYVNPLEVDPKASKEDPMKSHVKVQRAAWFGCACCPPNLARLVASVDQYIYTVTEDAIYADQFIGNETTFDNGLTIEQTGNFPWSGNVQFAITAKKTVKTTVAIRIPAWSRDHYAVTVNGQPLAVELDQGYLRIKRNWSGTTQIAVTLDMSVQMVHADPRVKDDVGKTAIQRGPVVYTLEQADNGCQLQANTLPVTPAFTVTPDDQTFAVPIVKITTTALHTDAATPIGNLYGTPATTLTHKKQLTFIPYFAWANRTPGEMMVWVHQM

SEQ ID NO: 7102 - protein, 184 aa, Lactobacillus casei
LYLMKDITRDGAKVLRERAKPVTFPLSDEDKKLAHDMMAYLVISQDEEQNEKYHLRPGVGLAAPQVGQSKAMAAVLVPGENNEILFKEVLINPRIISNSVQHAALAEGEGCLSVDKDIPGYVVRADRITIAYQNEAGEHKKVRLKNYPAIVCQHEIDHLNGVLFYDHINKEHPFSIDPNAVLIH

SEQ ID NO: 7103 - protein, 271 aa, Lactobacillus casei
MLMMISSGLTRYEAQRAQKAVTPHQNSISKTKLFLPLLAVLAGVSSLISFVSHSWLLTAIIAILLGFLIAVVVYLITALTRHQSNPQQSVLVVREGLVRQVQAQDLVVGDVLMLTAGEKLPVDVALSPEVHATLPSDMAGMLVLLNQQVPAGMGVAGAVMATDAQATVTAVWHNGLLDRALMQLANQSTNLASTSLVMSAVTAITLALKQICCVARMTVSILPAELFKSKQINRAVQIQLDMDFARHATLVGAMKHHSKTSDFWHNQDPVS

SEQ ID NO: 7104 - protein, 370 aa, Lactobacillus casei
MAKQHAAVDFKRLLDNQDADFKPTIQILDEVGKVVNPDIMPDLSDDQLVDLMSKMVWQRVLDQRATALNRQGRLGFYAPSAGEEASMIGSHAAMKKEDWLLPAYRDLPQLIQHGLPLDKAFLWSRGHVAGNEYPEDFHALPPQIIIGAQYVQTAGVALGLKKNGSDEVAFTYTGDGGTSQGDFYEGVNFAGHFKAPALFIVQDNGFAISVPRANQTAAKTLAQKAVAAGVPGVQVDGMDALAVYEVTKEARAWAAAGNGPVLIETLTYRYGPHTLSGDDPTRYRSKETDELWQKRDPLIRMRNFLTDKGLWDKDKEDALIEKVKDDIKNAINEADKAPQQTVSRFLKDTYEESPQNVAEQLAEFQGKESK

SEQ ID NO: 7105 - protein, 325 aa, Lactobacillus casei
MAQKTMIQAITDALDVELANDPKTLVFGEDVGKNGGVFRATDGLQAKHGEDRVFDTPLAESGISGLAIGLALTGWRPIPEIQFFGFVFETMDSIGGQMSRMRYRMGGTRSMPITIRAPFGGGVHTPEMHSDNFEGLIAQFPGMRVVIPSNPYDAKGLLISSIRSNDPVLFLEHMKLYRSFRQDVPEGTYTVPLDKAAVTREGTDVSIITYGAMVREALKAADNLAKDGINAEIVDLRTIAPLDVETIIASVKKTHKAVVVQEAQRMAGVAANVISEISERAILSLEAPIGRVAAPDTPFPFGQAENIWLPNAKDIEAKVRETVNF

SEQ ID NO: 7106 - protein, 546 aa, Lactobacillus casei
MAFEFKLPELGEGLAEGEIVKWDVKPGDEIKEDDTLLEVQSDKSVEEIPSPVSGKILKILVPEGETASVGDLLVEIDDGSGAPAQSAAPAASTAAPAAPAPAAAKSVYQFKLPELGEGLAEGEIVKWDVKAGDEIKEDDTLLEVQSDKSVEEIPSPVTGTVVKILVPEGETASVGDALVDIDAPGHNDTPVAGEPAATPATSTAGAETASAPSPAAGAVPAITDPNREILAMPSVRQYAREQGVDISQVPATGKHGRITKADVDAFKAGGSTSAAAPAQPAQAAAKSAPAQAAPAAPKPQPVAPYVSSGSEAELETREKMTPTRKAIAKAMLSSKQRSPHVTSFDEVEVSKLMAHRKKYKQYAADKGIKLTFLPYIVKALVTVLREYPEFNASIDDTTDEIVYKHYFNIGIATNTDHGLYVPVIKNADAKSMFEIAKEISDNAQKAYDSKLKPDEMRGGSMTISNVGSIGGGWFTPVINQPEVAILGVGKIAKEPYVNADNEIVVGNLLKLSLSYDHRLIDGALAQTALNLMDKLLADPDLLLMEG

SEQ ID NO: 7107 - protein, 467 aa, Lactobacillus casei
MVVGDFAIDLDTVVIGSGPGGYVAAIRAAEMGQKVTVIESTFIGGVCLNVGCIPSKALINAGHRYQDALDASTFGINAKGADLDFKKTQDWKQNKVVHTLTSGVSMLFKKHKIDSIMGTAFLKDDHSLRVMQKDSAQTYTFKNLIIATGSRPIEIKGFKFGKRILDSTGGLNLPEVPKEFVVIGGGYIGSELASAYANLGAHVTILEGTSSILPNFEKDMVQLVLNSFKKRGVTVITNAMAKEAEDTGNGVKVTYTADGKEQTLAADYVMVTVGRRPNTDDLGLDIVGIETTDRGLIKVDAQGRTNKPNIYAIGDVVPGAALAHKASYEGKVAAEAISGKASAVDYKAMPAVCFTDPELATTGMTLAEAKAKGIKAKASKFPFAANGRALSLAQTEGFVRLVTNEDGTVIGGQVAGAGASDLISELTVAVEGGLNVEDLALTIHPHPTLSETIMDDAEVALGLPINI

SEQ ID NO: 7108 - protein, 297 aa, Lactobacillus casei
MQRVVVHGASCSTQALLQTLIASPLDLEIGCYEPDAALVDVAGLTALSQICHNTFIKVTPKVLKTADVLILTDTGTPDDENFVATNIASIRKVLNSAMAAGFTGRVVVAMTHDERFTYFAQRFSGLNKRQVVGLGTFGATWRFEQFLADRLAVPAKQVTAYVVGTSQSPVLIWSRAYVGATPILRLLNDDQAVFTEAASAVHAFLASALTVLVGRLVEPILAAFAGEKLIGTFAHLRDSDDETGQVDSSPILLDERGVVTLATVAGSDDEEAALSTAIQAVQAEIEAIEQGADKNET

SEQ ID NO: 7109 - protein, 93 aa, Lactobacillus casei
MKPNYSYPLDLDWTTDEKIKVTTFFALIEDAYEHGVDRDNLLAAYRGFKQVVPDKGTERQLDREFEALSGYSMYTVVQMARQGVSQKIKVKVS

SEQ ID NO: 7110 - protein, 259 aa, Lactobacillus casei
MTQDPEKLRQTLISWFAESRKQILAEMAKPLDVARKSNRNDLVTNVDKANQQFLIDHIKAEYPTARIIGEEGHAHDDTDLNGLVFFVDPIDGTMNFVKQQAHFAIMIGVYRDGQPVVGAIMDVMRNEVLSGGPEIPVTFAGRTLTKLPDLQLKDGLLGVTGPMTIKNRLHLGDIALASSGPRMSGSAGMEFIEIALGRQLGYVSYLQPWDVAAGMAITKGLGVQFSREDGSPIDLRQPGVVVAATPQAHHTILTMMAGK

SEQ ID NO: 7111 - protein, 614 aa, Lactobacillus casei
VKTRDDIRNIAIIAHVDHGKTTLVNEMLKQSDTLDQHIQLQDRAMDTNAIEKERGITILSKNTAVKYGDTTINILDTPGHADFGGEVERVMKMVDGVLLVVDAFEGPMPQTRFVLKKALEQHLTPIVVINKVDRPGARPEEVVDEVLELFIELGADDAQLEFPVVYASAVNGTSSMDSDLSTQKHTMNPLFDTIIKTIPAPIDNSDEPLQFQVAMLDYNDYVGRIGIGRIFRGKIKIGDNVTVMKLDGSQKNFRVTKLFGFFGLTRTEINSAKAGDLIAVSGMDDIFVGETVTAADTPEALPILRIDEPTLQMMFVANDSPFAGREGKNVTARKLEERLKSQLQTDVSLRVDDTDQAGAWMVSGRGELHLSILVEEMRREGFELQLGRPEVIYRDIDGVMMEPFENVQIDTPEQYTGTVIDAMSQRKGEMQNMENEGNGQTRLTFLAPSRGLIGYSTEFLSSTGGYGIMNHTFEKYAPVIKNWEPGRTQGALVSINAGTATTYSLQSVEDRGQLFINAGTEVYEGMIVGQNSRENDIAVNVTKGKNLTNTRAAGKDHAAAIKTPKKMTLEESIEFLNDDEYCEVTPKNIRLRKKILNTGERQKAAKRKKIAASK

SEQ ID NO: 7112 - protein, 390 aa, Lactobacillus casei
LRKKLRHVDYFILVPYLILCAIGIVMVYSASAYWVQRQYGAAETKYLLQQIVFVVLGIGTVFFFDNMALKILRNRWVLFVLMSGLFVMLVYLIIHGRAVNGAAAWISIGSFRLQPSEFAKMILIFYLAHMLTSREDSFRQENFRLRQMWQPLFIAGMMMLLVFVEPDTGGFAILFLITLVVVMSSGIPMRYGLLWLVALIATGILGYYIVSHYHFPGLEHNYAYQRLVAAIHPFEKANAAGNQVVNSLYAINHGGLFGVGLGMSSQKLGYLPEPYTDFILAVIAEELGLVGTVVVLGLLFFLVMRFYLIGIRSKNTYHTLIAYGIATMMFVQTVFNVGAVAGVLPVTGVTLPFISYGGSSMIVLSMAVGIMLNISYHSERTQRKVEKTHA

SEQ ID NO: 7113 - protein, 1145 aa, Lactobacillus casei
MHKVLVANRGEIAIRIFRACEELGLKTVGIFAKEDALSIHRFKAQESYQVGAGKAPIAAYLDMDDIIRIAKQSGADAIHPGYGLLSENATFARKVRAAGLTFVGPRSELLDVFGDKVAAKEAAHKAGLATIPGTPEPTRDFSEIQDFTATHGFPVMLKAASGGGGKGMRIVHSEAELEAVYQNAVNEAKASFGDDRMYVEKYIASAKHVEVQVLGDEHGHLLHLFERDCSVQRRQQKVVEIAPAVALPVALRAKICQSAVDLMASLHYENAGTVEFLVDGDQYYFIEVNPRVQVEHTITELITGVDIVQSQLRIAAGADLFADLHLPQQDELRENGAAIQCRITTEDPENNFMPDTGTINTYRSPGGFGIRLDVGNAYAGAVVSPYFDSLLVKASVHAPNFPAAVAKMQRALHEFQITGVKTNVAFLEHLLATKTFRTGEAETAFIDAHPELLQVQAKPDLASRLLWYIGDVTINGFKGVERQTQKYYPELQYDSHFPTTKPQTDLVALLKDKGANGVTDWVKDHKSLLLTDTTFRDAHQSLFATRMRTRDMLTVAKDMGNGLPNLFSMEVWGGATFDVAYRFLNEDPWVRLKKLRAALPHTLLQMLFRGSNAVGYQNYPDNVIKAFIQQAADDGVDVFRIFDSLNWLPQMTLSIDTVKQTGKLAEATMCYTGDILSDAHPKYQLAYYVALAKQLVDAGADMIAIKDMAGLLKPQAASVLIGALKDAVSVPIHLHTHDTTGNGIATYLAATHAGVDIVDVAQSSFSGTTSQPSLESLYYALSGDQRQPEVAIEKAQSLDRYFQAIRPYYADFGNGVTGPLTDIYTVQMPGGQYSNLQQQARSMGITDFEAVKAMYAQVNTLFGDIIKVTPSSKVVGDMALFMLQNHLTPEMVKDHGEQYDFPASVVAFFKGDLGQPVGGFPKDLQKKILKGQKPLTVRPGQLAKPVDFAAVRQDLIAAGVAEPSTEEVLSAILYPDVFKAFVRKQKQIGPVTKLDSPSYFQGMRIGETVSVPIKAGKTLIIQLNAIGTADASGMKTLYFTVDGQKQEIQIRDAHQKSAGLQHQLAEPTDKNQIGAPMAGKIVSVAIKQGQQVAKGDALFVIEAMKMETTVHAPFAGTVTHLYVEAGALIKSQELLAKLQPGAAKQ

SEQ ID NO: 7114 - protein, 115 aa, Lactobacillus casei
MFSMKQRQGLVVWVYSLKQLKTLRRYGTIMYVSRRMKYVYLYMDRDEITAASNKLSKLRFVKRVEPSHRPELKTEFGSDIGKSKPTEEDLETKAKQRRRDRMTIDKPKGDHHASH

SEQ ID NO: 7115 - protein, 188 aa, Lactobacillus casei
MRVISGAFRGLRLNAVPGNQTRPTADKVKESMFNMLGPYFDGGHALDLYAGTGALGIEAVSRGMHDAVLVDRQYAAIKTINANVALTKHSENFTVLKMSVNKAIEHFTAAGQSFDLILMDPPYAQQHVIAQLAAFVSGDLLVPGGRVLVETGLDVVYPEVIPGYTKLRRQTYGVAQVLILERNEEDHD

SEQ ID NO: 7116 - protein, 167 aa, Lactobacillus casei
MTKKIAVFPGSFDPFTNGHLDTVLRASRLFDEVVVAAMTNTSKKALFSSDEKLALIAVSTADLPNVKAVAAPRRLTVEFAKSIGAQFIIRGIRNVADFGYEADIATVNHDLDSQIETVFLLADKQYDALSSTIIKEVAAFGGDIHRFVPAPVEKALYKKLGEPHQAN

SEQ ID NO: 7117 - protein, 362 aa, Lactobacillus casei
VSLIKPINRLKQKKRWRWLIGILVGVIVLAALLFFPTNYYLEVPGSAESLKPYVKVTGSKDNAKGSYMLTTVGVVGPASPALLLFSKTQAHTDIVSKQDLMGNDSSAEYDQLQAYYMKSAANNAVAAAFKAAKKPYQIHHRGIYVMSILPQSPFKGKLALGDTITKLNGKSYKTADAYVNAIKSQKVGTAITLTYQHQGKTKQATAKLIRLPQTKRAGIGITLTENTAVTSDPKVKIDAGNIGGPSAGTMFALQIYTQITHQNLRRGHVIAGTGTIDPAGHVGQIGGIDKKVVAADAKGSKVFFAPNQPATKKLKHYDPNYVNNYTEAVQTAKQIKTKMKIVPVKTLSDVIRYMENYSKTAK

SEQ ID NO: 7118 - protein, 220 aa, Lactobacillus casei
MTTLTYWLKTYWYAPLIIVIGGFFFWQQAQGSSANQPLSESGRASGSSQVMMSRSSGSASSRSRPSQGFVHLKGAVLRPGIYPVRENTRWDEVVKAAGGLTANADMQQVNLAKIASDQESLHVPEKGETVAAPVATATSGVASSGEAKAQAAGGGGAVDLNKADATQLQTISGIGPKKAADIINYRDSHGGFKEIAELKEVPGIGDKTFETLAPQFTLGP

SEQ ID NO: 7119 - protein, 734 aa, Lactobacillus casei
MSGRLILVTVALLAGIMGGIGFWWVTGLLVIWLIIKTDRTISICVGLFFVIGLGRGVMDVLQWRHPPQPHGSIAIPASAIKLKEGYVSFIGRAANGVSVSGRGTVSQAVASKLATNDQPVRLEGAYEVTRLAPARNQYEFDYATYAWQSRQLAYELVKPTLDFSFQQKQQLQDVIDGWRVKIFAYFAQLPPKVRQYAKGLLLGQMDDDFMTQRQAFVDLGVFHLFSISGLHLFALVAALYWFAARLRIPQGVVDLALMGLLPLLLLLLPLGAGLWRAVWMRLAGIVNRYLQLGFTGLDLFGMVLMVNLIWQPRILMTMGGQLTYLMTGLLISLPTMRKWQLNWRLVLAGMPVIAWHTFSFNVLTVIFNWLLMPIFELAIMPGLVVALALPHSGVTRLFNDALQLLETVLIGLSRLPGQMIIGAFPSWLAVAGVLVMAIVITRLKWPLAISWFLVVLAWCWYQPNYRVVMFDVGQGDAILIEAPFRRGVMLIDTGGRIFGQTSHPPVSRAIVPYLHARGYARLNTLVVTHPHMDHLGDAPLLAQLMPISRLITTPTAQSHPMIRKVRQRVGTMQVVTADQQLQVGPLQFQVLWPTVDARPNPQDKNADSIVLYGKIGKSNWLFTGDADQTIERSQVLPRQLKADFLKAGHHGSKTSSDPAVVASLDLKAALISAGVANRYGHPHRETLETFAKAGVPVVSTHEQGMIWVESSPYRQEDELFGWLKIKESKSHAGP

SEQ ID NO: 7120 - protein, 353 aa, Lactobacillus casei
MQVRDFIKHLKNGDRPPLTLILGEEQALREQAQQAIANMIPEDQKAMNFGRYDMHQTPVGVALDDATSMPFFGDYREVVIDAPYFLTGEKSTDKIDHDLAGLQTYFENPVPSTMMVLVAPYKKLDERKRLTKALKKSALIVDAAPLDEHAARMALAQIFKQHKVSIEAPALDTLVQRTNGQYSIMMGEVRKLLTYASDGSPLTVAAVSALVPKQLNDRVFDLVTDVLRKHAADALALYRDLLAQREEPIRLNALMLGQFRLLLQVKLLAQKGYGQGNIATTLKAHPYRVKLALRQVDRLPYQQLTQAYSGLVDTETAMKTGTIDKELAFELFMLKYTGQSSAGHRGNQRQSVR

SEQ ID NO: 7121 - protein, 84 aa, Lactobacillus casei
MPQIKSAIKRVKTQEAARERNIAQLNAMRTAVKKFKSATEQNADNSQDLYKAATRAIDMANSKGLIKKNKAGRDKSRLSALLNK

SEQ ID NO: 7122 - protein, 89 aa, Lactobacillus casei
LAIDQTQKNEIIKQYARHDGDTGSPEVQIAVLTAEILALNDHLSVHKKDHHSYVGLMKKIGHRRNLLAYLRNKDIIRYRDLIKSLGLRR

SEQ ID NO: 7123 - protein, 31 aa, Lactobacillus casei
MLRFLTGLVHAHTKKGRLNRRPLVNSLTTQA

SEQ ID NO: 7124 - protein, 229 aa, Lactobacillus casei
MYEEYRQRYQNQLLRVTVLGVTPNSAWVLAGISGKWAFVAVTRDEPDQVITSQIDPAIVQLIRLIAKRLLGFDVNTSILPGSLKAMVTSFSSDDVNRPRKTFPLTLIRKPAGTSLDFWSLGEAAFLTVPDQKIQPADLRTWLVNLLPHAHGVGFGPVTDRAALAVMALDHGQQFAAGSSPEVAVVLANGREVAEYHLDAAQTSDAGYQAALETAKQNQATVRRFFADEV

SEQ ID NO: 7125 - protein, 560 aa, Lactobacillus casei
MTKINLVALGGVRENGKNMYAVEVDDQIFVCDFGLKYPDNELLGIDVVIPDFSYLTENADRIAGIFLSHGHADAVGALPYFLVDHPVPVFGSELTIAMAKVFMQHDSQAKKFKDFHVIDEKSVIDFGDVSVSFFKTTHSIPGSLGIDIETSEGQIVYTGDFKFDPSATPMYQTDWSRLAQIGNKKVLALLSDSANAESPYPNANEHEIYDHIKETFEYQDGRIIVAGVASNIQRIQQVINAAASLGRRVVLTGRDVEKVVKTAIRLGYIKLPNDDILAKTKELKALAPEKTVILETGRMGEPMKSLQRMATSRHRLIHIHDGDLVFITTTIAHAMETMAARTKDMIYRAGGDVKVLGDDIHSSGHAYKNDLQLMIDLLKPEYLIPVQGEYRLLAAHAEIAHEAGIPLANIFIVGMGDILRYEKGQMNASGHVNAGNTMIDGIGVGDIGNIVLRDRKMLAEDGIFIAVVTIDRKKKRVVSTPKVTSRGFVYLKTSRDLLAESGTLVTETVQKNLDNKEFDWTHLKQDVRDKLSRFLFEQTKRRPVILPVIMEVNQNSAKRQ

SEQ ID NO: 7126 - protein, 301 aa, Lactobacillus casei
MAKMVSLPDNENRHFVIGEKALQKGNFASAAAHLEKAYEVEQNFATARPLAASLNGLKQYHESLNVILPHYKTFLETDADTQLALDAWLGTLNFVMARTMLRELEPERRQHFLKQIEKAEEVVLKQRGEQIADLVRKLSHLGGFSRQEQQDLFSQIGLLPKAKLIEAAVPDLTDLSVPVAMRVSLLDLLTNVGYDQPVQYQAYDRQETLIPSELPGMAEEKAGPQILARLQDALGDDDQELGKALVQMARVQVAFLYPDIERLIPDQAAFVQAYLDHHQGKATNFDKLFAWQAAETAKLSE

SEQ ID NO: 7127 - protein, 396 aa, Lactobacillus casei
MAEKEHYERTKPHVNIGTIGHVDHGKTTLTAAITKVLAEKGLAKAQDYASIDAAPEEKERGITINTAHVEYETEKRHYAHIDAPGHADYVKNMITGAAQMDGAILVVAATDGPMPQTREHILLARQVGVDYIVVFLNKTDLVDDPELIDLVEMEVRELLSEYDYPGDDIPVLRGSALKALEGDKEQEKVIMELMDTIDEYIPTPVRETDKPFLMPVEDVFTITGRGTVASGRIDRGTVKVGDEVEIIGLKPDVLKSTVTGLEMFRKTLDLGEAGDNVGVLLRGINRDQVERGQVLAKPGSIQLHNKFKGEVYILTKEEGGRHTPFFSNYRPQFYFHTTDVTGVIELPEGVEMVMPGDNVTFEVDLIAPVAIEKGTKFTVREGGRTVGAGVVSEILD

SEQ ID NO: 7128 - protein, 288 aa, Lactobacillus casei
MVNYNNQFFHGERPLFGQEHATIVGTTFGKGESPLKESRHIKLNQSIFQYKYPLWYSQHIAVTNTIFETMARSGIWYTVDIAVSDSEIQAPKTFRRSQDIRLKNVHFSDASESLWNCDHISLDHVQASGNYFGMNSSNIVADHLNLIGDYAFDGAKNVEMHHSTLVAKDAFWNSENVTIYDSTINGNYLGWNAKNLTLINCTIESNQGLCYIDHLTMKNCALLHSDLVFEYSTNIDADICSDIISVKNPGSGSIRAHSIGKTILEADKIEPEKTQITLAEPSETKQSA

SEQ ID NO: 7129 - protein, 244 aa, Lactobacillus casei
MSAMSQKQRLQQAAALIRQHHRIVAFTGAGISTESGIPDLDGIDQILKRSHKFAGNVFRFLDPKEAIADPHAFYQMYRQTFCQPQARPNNAHKALVQLEQAKKLLGVVTMNVDYLHQKAGTHNIAEYWGDVRRNHCTICHRPSDWQKTPTAALPICPNCGGLILPDFVLRHLATYPDEIRHGQQMLAQADLLLIIGTRQSASGFRLGCPKIVINASRVSMENLAEPNTVYLSGKAAEILSSIVA

SEQ ID NO: 7130 - protein, 124 aa, Lactobacillus casei
MSEKTRLENGQETLAQVDGAAAANVMHSLADIAPDVGKYILEFAFSDIYNRPGLDLKQREMITLTALLIQGDTADQLQVHLNGALNVGLTKTEIVETMIHCIPYIGFPRVLNGLTVARRVFETR

SEQ ID NO: 7131 - protein, 127 aa, Lactobacillus casei
MGYSIGKFSKMVSLSIDTLRYYEKEHLIVPDRDQNNRRTYTDADQRWIAFIKRLKATGMPIKEIKTYARLRYQGNSTIDERLELLFTQKARLTAQRQEIDAHIAFLENKIATYHQLKAKLLEKNLKK

SEQ ID NO: 7132 - protein, 578 aa, Lactobacillus casei
LAKSTTWRMIAFFWRQLADMKRKLLRIIVALVGVAVASYLVPRITQYVIDQVIPQRAMGTLLGAIALALLLTAVAGLLSGLSTYWIGQVSLHAIARMRDDLFRHTLGLDMRYFETSQTGDLMVVLTSDVNTLQRLISSNTLGLFGSLLSFVVVLVLMIVQDWQLTGLILLTFPVLFVLNNIFVRSIRAAYRQVRASSGMMNNQIQQALTSIGLIKSFTTEEMTATTFQHANARNRDYQLKATKLSATFSPLTDFVNYLGTAIILGFGAIQVMHGQFTVGLIVAYTAYLGILQAPIRQLTGLIQQLQQATVSFERIEALQAASPQIVSPPNAVRLPRFQKQIRFDHVDFSYDEDVPVLHDINFAINKEEVVALVGSSGAGKTTITNLLARFYDPTGGRILMDGIDLRQADLMSLRQQIAIVSQDVILLDGTIQENLEYGTPSASEAAIWQAAEAANIADFIRSLPQGLATQVGERGIRLSGGQKQRIAIARVFLKNAPVVILDEATAALDNESERFVQASFDRLMADRTSLVIAHRLSTVRHADKILVLEHGQIVEAGNHEQLMAQNGRYKELYDLQFN

SEQ ID NO: 7133 - protein, 446 aa, Lactobacillus casei
MSAKWEKKGTNDGELTFEIDLPKIQQGLDQAFQRVRKNLTVPGFRKGKVSRTVFKRMYGDAALYEDALNILLPDAYEAAVKESGIDPVDQPKIDVESMDEGKPWVIKANVTVKPEVKLGEYKGVEVPKQDVEVSDDDVNAELEKRREQQAELVVKDDKAAENGDTVVIDYVGTIDGKEFDGGSSKNYSLELGSNSFIPGFEEQLVGHKSGDEVTVKVTFPDDYKATDLAGKAAEFKTTIHEVKVKELPELDDDFAKDLDEDVDTLDELKQKIKKELTDQRKEAAKNAVQEAAIKKATENATIEEVPSAMIEQEVHNQMDQYLGNMQRQGIDPKMYYQLTGTTEADLHKQFEADAETRVRTNLVLEAIVKAEDIQPTEDQVKEEVKNLASEYNMDEKAVRQALSEDMLKHDIGVKEAIDIITDNAKEVEPAKDEEADKADSDSETDK

SEQ ID NO: 7134 - protein, 416 aa, Lactobacillus casei
MFDNVETTGPVTCSFCGKSQDQVKKIVAGPGVYICNECIDLCKEIIDEEFKEEAYQNLLEVPKPIEIMKTLNDYVIGQDAAKKALSVAVYNHYKRVNQMQTATKDDTELQKSNIALIGPTGSGKTFLAQTLAKILNVPFAIADATTLTEAGYVGEDVENILLKLLQNADYDVERAEKGIVYIDEIDKIAKKAENVSITRDVSGEGVQQALLKILEGTIANVPPQGGRKHPQQEFIQIDTTNILFIVGGAFDGIESIVKNRIGEKTIGFGTDSNNQVDPDKSLMQQIIPEDLMQFGIIPEFIGRIPILAALEKLNENDLVRILTEPKNALVKQYQKLLSLDDTDLEFTPNALKAIAHQAIVRDTGARGLRSIMEAIMQDTMFDLPSRSDVDKVVVTKAAVEGKAKPQLVLTKGREAS

SEQ ID NO: 7135 - protein, 200 aa, Lactobacillus casei
MDVHDVKLTISAVAAAQYPTDGRPEIAFLGRSNVGKSSLINRLIKRKAMARTSSVPGKTQTLNFYDLDSRLFFVDVPGYGYAKVSKAARAKFAAMIETYLTTRQPLHGAVLLVDSRHDPTADDISMYQYLKYYQIKTLVVATKIDKTPKSKRLHVVKQITKRMDLNQTDVVIPFSAVTGEGYDAIWSWLEQTAGVEGSLK

SEQ ID NO: 7136 - protein, 96 aa, Lactobacillus casei
MNFNEYQQKANRTLAGNEHVLTNLSLGLASESGEAIDLIKKYTFQGQDLDKEELKHELGDVLWYLSQIALWADIDFDDVANDNIKTLAKRYPQSKK

SEQ ID NO: 7137 - protein, 53 aa, Lactobacillus casei
MALKINTQTNLNDMFDKFASLPGDKEQATGPDPKHQEKLAKKAHKTDEKKAKD

SEQ ID NO: 7138 - protein, 485 aa, Lactobacillus casei
MNHLKRWLVALFAVFAAVVTLNMQTVHADDSLAKIQQKGTIVMGTSPDYAPYEFLVNKHGKNQVVGMDVEVARKIAKDLGVKLVIKQMNFSSLLVALQSGKVDMVLAAMSPTNARRKSIDFSNTYYKSGQDIIINKTDAKIYKDHKSFANKKVGVQNGSLQETLAKSQMKSSTTLGLTKVTDLILALKTHKVAGVVAEGAVAQAYTSNDDSLVEIPGHFNLSSDTMGTAIGFAKGSDSLVAAVNKSLAEIKQKKLIPQYLKTAGSYMKTNTEDTSMLHYWTYFLKGVEYTLLISAIGAFFGVLLGTIFALLRLSKHRLPHLIGVAYIEFVRGTPLMIQVMFVYFGIGIFIDIPALVAGLIAVSLNSAAYVAEIIRSGIDSIPVGQTEAARSLGLSERQTMTSVVLPQAIKNIWPALGNEFISLIKESSIVSIIGVTDLIYQLTVVQTATYKGVQPILVAMVLYFVLTFGLSKLLSHFERKMNHAA

SEQ ID NO: 7139 - protein, 248 aa, Lactobacillus casei
MQHKPLIQINHLTKKFGDNVVLNDISETINQGDVIVVIGASGGGKSTFLRSLNLLNRPTQGEILFEGTNLVDLSEKQLDNVREKMGMVFQSFNLFPNMTVLENIKLAPLKVKTVTDEEATKTAKELLEQVGLGEKADAYPASLSGGQQQRVAIARALAMHPDVMLFDEPTSALDPEMVGEVLKVMQDLAKTGMTMVVVTHEMGFARSVADQVWFMDGGKILEKGTPEELFEHPKEARTQDFLSKILAQ

SEQ ID NO: 7140 - protein, 602 aa, Lactobacillus casei
MASAHIEHKLSLLPDLPGSYQMKDINGKIIYVGKAKNLKNRVRSYFKSSHDGKVAAMVAQVADFDYIVTSTNKEAFLLEITLIQKYQPYYNIKLKKGTGYPYIKITHERDPKIEITGTIRKDGGYYFGPYPNVYAAQETMHFIQKVYPLRRCNGYQGRPCLYYHMGQCLGACFRTVPEKEYADQIARIKRFLNGNVSKAKASLTAKMERAAKNLQFERAAEIRDQLYYIEQTVEKQKIISNDNTTRDLFNFYMDKGWISIQVFFIRQARLMKRESRLFPVVNTAKEEFESFILQFYSRKNNVKPHEVLVPAGLDNKVLADILGVPVRTPQRGEKRDLMALAAKNSQIKLEDKFRLMELDNRTTIGAMKELMAALKLPMGHVVEAFDHSHIQGADPVSAMVQFVDGQPAKNNYRKYKLDADKTHNGADEAANTREVIRRRYTRLLKEHAALPDLILMDGGEIEMNAAKDVLENELNLDIPVAGMVKNNKHKTAALLFGNADQMINLDPKSQGFYLLERIQDEVHRFAISFHRQLHAKNSLASRLEGIKGVGPKTRLKLLRKFKTITKIKEAPIEDIQELGISKRVAQALKLSLTADPTPARRV

SEQ ID NO: 7141 - protein, 668 aa, Lactobacillus casei
EIIABCCMPNENTMDIRDLLLKNVMIMDLKGTTKEAVINEMVDKYHAEGIVTDADEYRQDILKREAESTTGIGEGIAMPHAKDSAVTRATVLFAKSAKGVDFNALDGQPVHLFFMIAAPEGANNEHLAALAALSSLLINPKLVADLKQAKTPDEVLDLFGKAQAEKVAKDKKEAEAEKAQEAKDAAAKQAEFKEEKRKERPFIVAVTACPTGIAHTYMAEAALKETAEKMGVDIKVETNGSEGIKHKLTDSDINRATGVIVAADKKVEMDRFNGKKLLNRPVIDGIKKPEELIEETLKGQGQVFHASGANTQSSDTEETSGGLWNRIYKDLMNGVSNMLPFVVGGGIIMAISFILEQWLGKTSMWFTFTNNLGTFAFSFLVPVLAAYIAESIGDRPALMPGFVGGYMATVASASVVKAQNPAGFLGGLVAGFAAGWMIVGLKKALAKMPKSLDGMRTILLYPVIGLAIMGLLMFFIINPIFAAINGALISFLEGMGTGNAILIGVILAAMMSIDMGGPFNKAAYTFAIGVYQASGFKDGRWMAAVMIGGMIPPLAIAVASTFFPKKFTLQERNAGLSNYALGLTFITEGAIPFAATDPVHIIGSSVVGSAIAGGLTQLWHVNVPAPHGGIVALLLTNQKLGFVMSLIIGTVIAALILGFWRPVAKENQ

SEQ ID NO: 7142 - protein, 304 aa, Lactobacillus casei
LIYSVTLNPSIDYVIELPQLDLGAVNRLTHAVKLPGGKGINVSRILQTLGLPTTAWGFLGGFTGTFIQQQLDAIAMPCDFTKIKGDTRINVKLKAESETELNASGPTITNDEIANFKAKLAKLAAGDVVVMSGSLPQGLPATFYRDLIPAIHEHQADFVIDTTGQALLDTLPDHPLVVKPNHHELAALFNDKPYADNDAIIKAGRRLLDQGAQHVLISMAGAGALMIERDHAWLGTVPKQPAVNSVGAGDSMLAGFTGTFAQTHDALESFKVGIACGSATAFSKDLATADKIAAVKQTISITEV

SEQ ID NO: 7143 - protein, 249 aa, Lactobacillus casei
VLTEERRQYILSQLQQHTVVKSKALMAALDASESTIRRDLDELEAAGELKRIHGGAKRINGLGDEPDVASKSTQNLRAKQAIARAAAHQVEQDDLVFLDAGTTTAQLIPFLADLGVTVITTGVDNASLLADYQIPTLMLGGMVKSATKALIGATTAEALHHYRFDIAFIGTNGIHPEFGNTTPDPEEAVIKRLAIHQARQPMILADPSKFEQVSFVKFADIGDVTILTSSLQALPAGYHRFQNIKEVHS

SEQ ID NO: 7144 - protein, 428 aa, Lactobacillus casei
MFVDQVQVEVQAGKGGDGMVAFRREKFVPFGGPAGGDGGRGGSIILYVDEGLRTLMDFRYQRHFKAPAGGNGQGKSMYGRAAEDRRIAVPAGTTVTDADTGEVLGDLTKPGQELLVAKGGRGGRGNIHFVSPKNTAPEIAENGEPGQHRFIKLELKVLADVGLVGFPSVGKSTLLSVVTQAKPKIAAYQFTTLVPNLGMVQLDDGTDFVMADLPGLIEGASHGVGLGIQFLRHVERTRVLLHLVEMDPENGREPLEDYDQIRRELGAYDENILKRPELIVATKMDLPGADERFAEFKAALLKRGIDPANIFEISSLTHRGVMPLMHRTAQVLKTAPQFEPKQETVKTADYKFAPEPALKVTRDSDGTFVLTGEKVERAFKMANLDHEDGVMRFARQLRSMGVDDALREAGAQSGDLVAIDDFTFEFVE

SEQ ID NO: 7145 - protein, 662 aa, Lactobacillus casei
LKQTRRRKRRYIHGFDGLRTIGVIGVILYHLRPELFRGGYLGVPIFMVVSGYLITDGLLIEFNRNGRIDFKSFFIRRFKRLYPALITVLFGTAAYITLFSQNLLHNLHMMVLTNLLYVYNWWQILNGQSYFARYANGESPFTHLWTLSIEGQYYLVWPFLVLGLLLLVKNRHQIANIVLILAAASGAWMAILYMMTVAHTSPAAFDPSRLYYGTDTRAFSILLGAALAFIWPSGRLSEHLPRKWVVSLDLMGTVSFVGLLAMVFTVDAQSSFLYEGGMVLFSILTTILVAVVAHPAAHFDRLLSNPLFSYIGSRSYGLYLYQFPVMIFWENRFRNIADHPVLYPVIEVVLIVAISEASYRWIEQPAAHFDYHKTWAFIKGLADPKKRMGKARWISYAALVILAIGSVGLAKAPSAKAVGDDSPLAKQLKKRAESPKEKAKRLEAMRSSLAEERKEAKNKTEQKSRSRAQESKYASQAKAHPVNQEYEQYGLTQIELQRAQDLGLTAIGDSVMLDGQEGLQKIFPKAVIDAAVSRQMINSIDLVRSYAEKGVLANVVLIGLGTNGPFSDEQLAQMMQAIGPDRQVFWINVRVPTRAWQNDVNGRLDAAQKQYKNLTVIDWFRKSDGHPDWFYKDMVHMNPTGNPQYAAFIAKTILDKTKQSAD

SEQ ID NO: 7146 - protein, 319 aa, Lactobacillus casei
MEIQFLGTGAGSPSKVRNVSSLALKLLDERNEVWLFDVGEGTQHQILQTTIKPRKIAKVFITHLHGDHIFGLPGFLASRANQGGTDPLTIYGPPGIEDFVRTSLKVSQSHLSYALKFVLLRHPGTVFEDQTFKVSFDRLDHRITSFGFRVEEKPHPGELLIDKVRASKIPSGPVYAELKAGKQVTLPDGRTFDGNDFIGPAQPGRIVTIFGDTRKCSRALPLAAGADVLVHESTFGPDESQLAKQYYHSTNIQAAELAKRAGVGKLLLNHISARYLGPGVAMLEKSAQRIFPNTHVVKDFEEVNIPFASPQLTSAGSVQ

SEQ ID NO: 7147 - protein, 260 aa, Lactobacillus casei
VKQHLTVVISGGSAGLGKAIGLEAAKKGATVVFLARRRDKLRQAQAEASSLSGRPAFAFPVDVADPVAIEAVVERIHATVGSVDVLVNAAGFGHFENAFDTDMHLVERMFRVNVLGTMYLTKLLGRDMAIRGQGHIINVSSMAGKIATPKSAIYSATKFAVVGYSNGLRLELKPFGVNVTTVNPGPIATDFFKSAGALDYLASVSWLVLDPDKLARRIVATFNHPVREINTPRLMNLGADLYTLFPHIGDWLAGGLLNKK

SEQ ID NO: 7148 - protein, 108 aa, Lactobacillus casei
MKGQQRFIIGLVLALILIIFALLNGQGVSVNFFGIQLEWPLIVIIAVSVLIGAVVTWLISTSAVANAKKQIRELQQRITELTKANKAEKPAPKPVQAPKEEPVDSTKK

SEQ ID NO: 7149 - protein, 868 aa, Lactobacillus casei
MNPDNFTQAVAEALGAAQQIAQVRHHQEIDIPHVMKSLVQPNQLAEQIYREAGVNVQGLNAAIDAALEAEPVVEGASTYGQSMSQNLAQLLTDANTVKDEFGDTYISTEALLLALYQQRYNTITQYLLNDAKVDAKKLRQVIDKIRGGEKVTSKNAEANYKSLEKYGTDLVKEARSGKMDPIIGRDEEIRDVIRILSRKTKNNPVLIGEPGVGKTAIVEGLAQRIVKNDVPDNLKNKTIISLDMGSLVAGAKYRGEFEERLKSVLKEVKKSEGQIILFIDEIHNIVGAGRAEGSMDAGNLLKPMLARGELHLIGATTLDEYRENIEKDKALERRFQRVLVQEPSVEDTISILRGLKERFEIFHKVRIHDSALVAAATLSNRYITDRFLPDKAIDLVDEACATINVEMNSRPTELDVAERKQMQLEIEQQALKNESDPASKKRLENADAELANLKEKTNKLKAQWEAEKKDIRQLNEKKSAIDKAKHELEDAQSRYDLETAARLQHGTIPQLEKELQAMENNDRPQSWLVQESVTENEIAAVISRETGIPIAKLVEGDRQKLLHLADNLHKRVIGQNEAVTAVSDAVLRSRAGLQDPSRPLGSFLFLGPTGVGKTELAKALAEDLFDSEKHMVRIDMSEYMEKASVSRLVGAAPGYVGYEQGGQLTEAVRRNPYTIVLLDEIEKANPDVFNILLQVLDDGRLTDGQGRTVDFKNTIIIMTSNLGSEYLLDGVQADGTVSQQAKDQVRQLVNKAFKPEFLNRIDDIIMFHPLSLDDVKQIAVKDLHQLGTRLADQQITLDITPEAQTWLADKGYDPAFGARPLQRLITSAVETPLAKELIRGTIEPGQEVVITVVDDQLQFKAKQVAAKA

SEQ ID NO: 7150 - protein, 63 aa, Lactobacillus casei
MAVPARRTSKTKKRMRRGHIKLNVPNLQFDAATGEYRVSHHVSPKGYYKGAQVVKKSDDNANA

SEQ ID NO: 7151 - protein, 184 aa, Lactobacillus casei
MADNKKFADYLRQLQEAQFPRWADLPQFDLYMDQVIQYVNDIVSPLGFGEITSTMVNNYVKKGVIKAPIKKKYRPEQLANILVIAMLKPVFALDMIAKGIRFAKEGRPVAQAYDTFILTFVSAIEQANSDFNDALTINRVNKPDTTATQHAVVTLAINAVLQKLMVEKMLELEEEPAPKEGKKA

SEQ ID NO: 7152 - protein, 517 aa, Lactobacillus casei
MKLTILSTSDTHGFVLPTNYVKRQQDLPFSLTKAKTILDAQKAAAPGPVLTIENGDWLQGSPLAYYVAKISRQPEQLTQIYNAVGYDAGIIGNHEFNYGADYLRQALATLNYPTLNANITRDGKPTFGAPYQIFERDGVKIAVLGLTTSYIPHWEAPKNIAGLQFQDVITTAKYYVPRLRQQADVVIVAYHGGFERDLRTGQPTERLTGENVGYALTQIPGIDALITGHQHRQLAATVNGVPITQPGYRGEAVGKITLTLTPTATGYQVTDSKAVLVKAGASAASEAIVDVAKPLNQVVETWLDQPLAKVQGDMRIRDPFAARVHETPYIEFIQRVQMASTGADISGTALFNNEGRGFGATITMRDVVTNYIYPNTLAVLRLTGADLKAALEQCATYFSLTADGQLTVTPRFERPKPQHYNYDMYQGIDYTLDIRQPVGQRVTKLTYHGQPVIAAQTYDVAVNQYRAAGGGNFAMFGPEKIIRENQKDMTELIADYLKVHPTLEAVADHNFTVLPSM

SEQ ID NO: 7153 - protein, 286 aa, Lactobacillus casei
MKFWKYGLIGLLALLLVGCGQQLSTTKTTYGRDGLVATVKGNASGVKRVSYTSDAGKGSVPVNSGTFVIDVPITDKAQKVNLKAGSLKTNVTVKAGKSLGNYADIATKFNQMLAVSSLSKADQAKLKQGQAAAAALQKNAAGMTPAEKMAAAQQAQALKTLMAQATANTKANQLPTTAKTGIQSILKTADINYRASVAHGKAMGFAVIVPLAVLKDSKKMQAFATDFGLLSTAVGANAKTVFSHFKKLTKDAKSKNNATTISTIKSNGVHFDVGYSTTALYLYVTK

SEQ ID NO: 7154 - protein, 64 aa, Lactobacillus casei
MRYLPTIVWGLILGQVVGFLVGALSGSSYDPKTSAIVSVIFIVILFFFPPVMQHFAKSAGKPEH

SEQ ID NO: 7155 - protein, 1098 aa, Lactobacillus casei
MTFTQLQVHSNYTLLHSPLALPDLIQAAKTRGYTAIALTDTNVVYGLVEFYRQAKAAGLKPLLGMQIDIDDARLLVIAENNTGYHQLLKLSTQIMLAKTPVKFADLLPLTGLAAIALPDSPFAEAVTTHHDEQAMAFLTALKAKQPASVYVGVDEAHLDSAIPAFIAAHQLEPLALGNVLYRDPTDAFTQKVMVAIDEGSQLNFRDPVLTDAGEAWLKPPTDAAAPFAAAGLQTAVDHTADIAARADVTIDFKQPQLPHYQTPDQIPSKDYLTKLAKSGLDARFHGQPIPEAYQKRLQYELHVIIEMGFADYFLVVWDVMNYAHKVNIMTGAGRGSAAGSLVSYALAITEVDPIEYNLLFERFLNPARAQMPDIDLDIPDNRRGELIQYVHDKYGENHMAQIITFGTFGAKQAIRDVARVFGLSQFESNTWSKAIPNLFHIDLKTAYEQSQPLKNLVADSPKNRMLFQTALALEGLPRHYSTHAAGIVLSEEPLTDTVALQPSGDGLEQTQVPKDDVEALGLLKMDFLGLKNLNILAAASHFVARDTGKPFDPKTIPLDDKPTLNLFARGDTNGVFQFESSGIKNVLRKLHPTAFEDVVAVNALYRPGPMENIDTFIARKNGQEPIAYPDPALTEILKPTYGVLVYQEQVMQVANVMGGFSLGEADLLRRAMSKKKSAVLAAEQDKFIEGAVKQGFPEETAKTVYAYIDRFANYGFNRSHAVAYSKVAFWLAYLKVHYPAAFFAALMNASMNNLPKLRTYVQEAKARKVGLLGPDINASNGGFKLSQGKIRFGLLSVKGMRRDFSEAIFTARQNGPFKNLRDLLQRLDPKWLKADNFKSLILAGAFDTFDANRAQTLANLDELINSVKLAGNDVGLFSMLAPKTIKVPEMSASERLEAEAEVLGVYLSGHPVDKYAPLKTQYTLVSVSDLEEGQTVNILLLVRHIKRIRTKTGKPMAFVDGQDATGNVSLTVFPNLYPTIEDLTTDMVVFVNGRVEKRHDDLQLVVNRIQDAQPLLASLPSAELFIRLDAKDTALRTDLLKKLQAAHGTTPVITVDTATRESILLDKRYWVKADTTLVEALKSQFGANNVVLRTRQES

SEQ ID NO: 7156 - protein, 319 aa, Lactobacillus casei
MKRIGILTSGGDAPGMNAAVRAVARKAMHEGLEVYGINYGFAGLVAGDIFKMSESTVGDKIQRGGTMLYSARYPQFAQEEGQLRGVEQLNKFGIEALVVIGGDGSYHGALALTRHGFNTIGLPGTIDNDIPYTDFTIGFDTAVNTVVEAVDRLRDTAASHERTFVVEVMGREAGDIALWSGVAGGAEDVIIPEHDFDVKKIASKLQSSRERGQKHAVILLAEGVMHADQFAKELAAYGDFQLRATVLGHIVRGGAPSARDRVLASQMGAYAVELLLDGKGALAVGIENNKITAHDVRTLFDAKHHAELSLYTLAEELTF

SEQ ID NO: 7157 - protein, 588 aa, Lactobacillus casei
MKKTKIVSTLGPASNTTDIIVKLIEAGANVFRFNFSHGDHEEHLARMKMVHEAEKITGKTVGIMLDTKGAEIRTTLEDTPDGTIEFHTGDKVRISMDASLKGTKEKVAVTYPGLYDDTHVGGHVLFDDGLIDMKITEKDEKNRELVTVVQNDGVLGGKKGVNAPGVAINLPGITEKDSNDIRFGLDHGINFIAASFVRKPQDVLDIRELLEEKNALNVQIFPKIESQEGIDNIDDILKVSDGLMVARGDMGVEIPFEHVPIVQKRLIKKCNALGKPVITATQMLDSMQENPRPTRAEVNDVANAVFDGTDATMLSGESANGDYPVESVAAMARIDEYTEAAMMDQDAFALKEYSNKNITEAVGQSVAHTARNLGVKTIVAATQSGYTARMISKYRPKADILAITFNEKTQRGLMVNWGVYPIIADKPANTDAMFDLATKKAQDLGFAKEGDLILITAGVPVGESGTTNVMKVQLIGSKLVQGSGVGDESTIGKAVIASNAQEAAAKMQKGDILVVKTTDKDYLPAIEKAAALVVETGGLTSHAAVVGIAMGIPVVVGAENATSVISDGQIITVDSRRGIVYKGATNAL

SEQ ID NO: 7158 - protein, 153 aa, Lactobacillus casei
VESWLFLLAILIIALVGKNKSLVIGVAVVMVLKLLPQTQHLMKLLQSQGINWGVTVISAAIMVPIATGEIGLKELLHVIKSPAGWIAIGCGVLVAVLSAKGVGLLAMSPEMTVALVFGTILGVVFLKGIAAGPVIASGITYVILTAFNILPGR

SEQ ID NO: 7159 - protein, 297 aa, Lactobacillus casei
MIIKMKFNGQIVTAHVTDHNEKEVFAQYDGVTLAIDRKELAALPEIGSELEGFAYENKHGEARLTTKLPKVGRDHYAFAPVVEVRRDLGVFVDIGLPDKDIVVSEDQLPELNRLWPQRGDRLMIALTTDKKDRLWGNLADETIIRAVANRAKPDQMNADVTATAYRLKMAGTRVLTDDFYLGFIHPSQRDVEPRLGQVLHARVIGVSDQGELNLSLKPRAYQAIGDDAAMILAVLQHDPAGKIAYTDKSDPDAIKQVFGISKGAFKRALGHLLKAGLIKEEAGYTILLKTNGNASQE

SEQ ID NO: 7160 - protein, 293 aa, Lactobacillus casei
MHGLIADFIHYLDVERGLAATTQISYQQDLMTFQAWLTSQKRTTFPEDFAVIQTFLKQQNDTKAPASVSRMISALRKFYRFLLREGAVKTDPMTKIDTPKKAQHLPATLSGPEIDALMAKPDITKPLGLRDRAIFELMYATGLRVSELIGLRMDQLHLAMNLLQVTGKGDKERLVPISPQATEWVNRYLRDARPRLIKQHQPKAVFVNFHGHALTRQAIWKNLKAYIASVGIQKDVTPHTLRHSFATRLLENGADLRVVQELLGHSDISTTQIYTHLSNQHLVAVYHKTHPRG

SEQ ID NO: 7161 - protein, 128 aa, Lactobacillus casei
MLVKYKNDYEKIAMGLLSFIPDLKDVGHLKTELKMYTEDDSHALYLYKQGHDFVGVIGIELSDDFVLVRHLSFSPNFRDQATAFAALTELTKLFPDKKLMGALEHASLIAAFNKFRKEDDHGTDTRAE

SEQ ID NO: 7162 - protein, 241 aa, Lactobacillus casei
MALTLVLNDFSGPLDLLWHLIRTNEVDIYDIPIAEITTQYLDYLHQMQDLALDVAGDYFVMAANLMVLKSRLLLPQPEPETTEPEEPTDPRADLVAQLLTYQVYQEAAKDLKHREAKRAQSFAKPTTLPDEKMAVPLAPGTVKLIDLQAAMARVMKAQQAARQTIAHIETEPVSVEKRIGEVLKTLQKDGQCLFADLLAVHSVEQVVTTFLALLELMKSDQVICEQDAPFDPITVTLKEAA

SEQ ID NO: 7163 - protein, 205 aa, Lactobacillus casei
MEPVLEAILYTAGESGVTLGELAGILEISESAMRQQLEAYQQKLAADEQRGLQVQQFADRYYLLTKPDFAAAIKKYFAGPPAAGLSQAALEVLAIIAYQQPITRIEIDEIRGVQSSGALTTLASRQLIKEAGRKEAPGRPILYATTQFFLDYFGLNRLADLPPLADAPEDTGEVDLFTAFRDDGQSQQAEDDKKMEQNQQDDNQN

SEQ ID NO: 7164 - protein, 248 aa, Lactobacillus casei
MTTKTERLQKVIAKAGIASRRHAETLIASGHVKVNGQVTTEMGIKVGPHDDVEVDGVPIGKEAKRYFLFYKPRGVISAVEDNKGRKVVTDYFEDIRERLYPVGRLDYDTSGLLVMTNDGELANHLMHPRYALEKKYVAKVEGIPNRPALAPLKTGVVIDGKMTAPAKFEILSTDKAKKTAIVALTIHQGMNHQVKKMFKAVGFPVIKLSREAYGNLTLAGLQPGEHREIKPQELHDLRQLTGDQDEKH

SEQ ID NO: 7165 - protein, 192 aa, Lactobacillus casei
MASRSKVHRLVGIALLAAIGYVLMMFSFPIIPAFPFLKLDLSDLVVLLGGLLYGPVGGISVAFIRSLVHFALTGGGVVNLIGDLAAFIASVGFLLPVVYTIRGKHSLWRQVEGLVLGTLSLTLVMSILNWLVITPMYMAVFNFNLGMSLTRYVLIGVVPFNLIKGVVISVAFFAIAKALAPWLARQEMQMSH

SEQ ID NO: 7166 - protein, 85 aa, Lactobacillus casei
MALYGRVERPECIACGLCQMLAPDLFDYDQAGIAYYKPDRNTGTKALDDQATIHFRLAYKRCPTHAIKRSDHPFDADPYTPTKAK

SEQ ID NO: 7167 - protein, 326 aa, Lactobacillus casei
LLPDLVIQFFNIQPRRERSVFGLLTGKQTISILYAALSHHQLQWLHLYPGLSKEAFLAAVAKLKAQKCLAATETGLVLTEIGQKRQIQAAEEVSLPAYYQPWMRVDRFAPRFFLAVQVLSEASYHSQAYRPISTDWATQQAVKRWYRQTRVQTAVDELTDLFERLPASLADELAANLIGHNYAGQRQPATLSAHFANVNALAALIQEIAAAKNQWYALWGGPQELVTRPAQATLKQVRLGVDLATVAAQSHRKMSTVKEHLLLAAIMGQDVPIARLIPPAVHHALDQVDQWQDHQTLLATIPDSEFFQIRLFQIFKLQGRWPRAAT

SEQ ID NO: 7168 - protein, 469 aa, Lactobacillus casei
VPQLETLLADHFGFEHFRPGQKAIIQAVLAGQDTLGILPTGSGKSLCYQLPTIIKAKPTLIIEPLIALMHDQVGRLQAAGEKRVLALSGQIAPNVFPEVLRNLGQYRYLFISPEMLQRADVLAALKQLDLGLFVVDEAHCISQWGPDFRPAYLQLGHVRSQLHVDAVLALTATAPERVRTDILTQLGMQNPVTIAGSVDRPNIFLGVDVCPNEEAKQQELQHIMAANIGSTIVYCPTRAASENLAGELQKAGMAAAFYHAGLDQHQRDLIQRQFQSDQLQVICATSAFGMGIDKANVRLVVHLYVPESLEAYYQAIGRAGRDGASSLAAMVVTQDDLKRSQALAGMLPDQTMIQTIFAHPEIYRNFDDPQVSLIEAYITAGFSLLQTQQQLEKRMTEKQNSFTAMAAFVNASGCRRALLLKHFDSPVPAHGSFCCGRVTSDVLQIFVTEKRHQTTQPKHWQAVFRQIFR

SEQ ID NO: 7169 - protein, 217 aa, Lactobacillus casei
MAEKDKHQHDSADQEHKRDDQNKPWETLFDDDRDDQGNLSRLATRKKRQGSSKFTWILAIILILLVLSPIIYVKVWGSQGSSGSNLSNDKVVIQSAKKASHRSKVKKSEKSSKAAKASSASTKEASSQQPSTQHVASKEATTAASTTAASAQAPSVASTAPSQASTASTAANSYTVISGDNLYRIARNHNMTLDELLQLNGLSANSSLTPGTVLKVK

SEQ ID NO: 7170 - protein, 221 aa, Lactobacillus casei
MQIAIDGPASAGKSTIAKLVAKKLGFIYCDTGAMYRTVTYMALKDQLPLDDETAIMQHLAKMVIRFAPGETEQRVFMNDEDVTLAIREPDVTNNVSQVSALPRVRTELVKRQRDIAATHDIVMDGRDIGTTVLPHAALKIFMVASVTERAKRRYKENVQKGITTPLATLEAEIAERDRKDSHRAVSPLRQASDAIRIDTTDMSIDEVVARILTLVTETKTH

SEQ ID NO: 7171 - protein, 437 aa, Lactobacillus casei
MSDNNVNENTETMADALKSVTTVKIGDTVKADVLAVEDKQLIVGIEGTGVEGVVPIKELSTQPIDDIHDVAKVGDKLDLVVLSTVGKDKENGQFLLSKRRLEAQKVWKEIQAKYEAGETITAPVTSVVKGGLVVNAGVRGFVPASMVEDHFVEDLNQYKGKELEFKIIEIEPSENRLILSHRAIVEASKAEARKEIFAKIQPGDVVEGKVARLTNFGAFVDLGGVDGLVHVSEISFDHVDKPSDVLKVGQEIKVKVLNVDPDRNRISLSIKATLPQPWDNIEEKAPAGSVLTGTVKRLTTFGAFVEVFPGVEGLVHISQISHEHVATPADVLKEGQEVKVKVLSVDPDAHRLALSIKALQDRPAGASETPAHEGGNNSGNNERRRSSRPRRGNDRHQSTSIPAEYQQDDSGFSLGDILGDALKDAAKGKNDDQDDNK

SEQ ID NO: 7172 - protein, 435 aa, Lactobacillus casei
MVLPTLAIVGRPNVGKSTIFNRILGERVSIVEDTPGVTRDRIYGKSEWLGKEFAVIDTGGIDLGDEPFLSQIKDQAEIAIEEADVILFLTSVEAGVTDADERVAQILYRAKKPVVLAVNKVDNPERRQDIYDFYSLGFGEPFPLSGTHGIGLGDVLDAVLAAFPKEANSVEDDSIKFSLIGRPNVGKSSLVNAILGENRVIVSPIEGTTRDAIDTKFEADGETFTMIDTAGIRKRGKVYENTEKYAVLRALRAIDRSDVVLVVINAEEGIREQDKKVAGYAHEAGRGIIIVVNKWDTVEKDNHTMKDFENLIRQEFQYLDYAPIIFVSAKTKQRLQSLPAMIVEVSENQTRRIQSSVLNDVLMDAITVTPTPTVNGKRLRIYYMTQVAVKPPTFVVFVNDPDLLHFSYERFLINQLRQAFDFSGTPIHVIARQRK

SEQ ID NO: 7173 - protein, 91 aa, Lactobacillus casei; identical to SEQ ID NO: 3417

SEQ ID NO: 7174 - protein, 422 aa, Lactobacillus casei
MSYAQKMLDALETGQMETARQLFTQVLKHDDDETQYNLAEELYAMGFNGQAKRLYQGLLGRYPDQGDLATALADIAVSDGDTDAALNYLSRIQPGDPAYVQSLVSAADVYQTLGLYEVSEQKLLEAKKLAPKEPVVTFALGEFYFDWGHFPQAIAAYNELLAGGTKELAGVNIEARLAASLAQTGQYEDAVAAYEDVGVDALDLNGRFELGGLYLQLDDPAKAITNLQAVIDTDPSYANAYLPLARAYEAQNQPDKALDTVQAGVMVDNTNPDLYALGGKLALSEDNPDLAENYLQKALKIDPEDQGNMLAWSNFLVQQERDQENIDFLSQIDRSGDVDPQIYWNMAKSYDRLDDVKKARENYLLAFNRFQDSPDFLHDLIDFFQSTGARAELKAALVRYLKLVPTDDDMQMRLDELNDEAD

SEQ ID NO: 7175 - protein, 292 aa, Lactobacillus casei
MSRNMRICLDLLMIVLGCALYGFGLVYINIANHLAEGGVTGITLLIRYWWHVDPAYSTVLLNIPLLIVGYKFLGKRALVYTIFGTLMLSAWLWIWQRVPLSIDIHHDLFISGVLAGLFGGFGSGLIYRHGGTTGGTDVVARIVEQQTGVPMGRTLLIFDAIVLTISLTYLNLELMMYTLLGAYVFSRIVNFTLDGAYAAKGVLIVSDHSQAIATAIMNDLERGTTFLHAEGGFAHDHKQVVYAVVASTEIAYTKRLIEAIDPHAFISILDVHEALGEGFTYQKKRRRLLFGH

SEQ ID NO: 7176 - protein, 398 aa, Lactobacillus casei
MQLDLKQPDFQAAIPILKKIEAAGYEAYFVGGSVRDALLGLPIHDVDIASSAYPEEIKRIFKRTVDTGIEHGTVMVLDHGTGYEVTTFRTESRYQDFRRPDHVTFVRSLAEDLKRRDFTINALAVRHDGTIIDLFDGLADLKKHELRAVGDPHERFHEDALRMMRAVRFESQLGFHIEPATKEAITANAPLLKHISVERIAAEFNRLLIGIDRRFGIQDFVTTGLFAYAPALAGQRTALWHFSELPDTPFSGIASGWSALLFMLKLDPEPTLKAWKQSNDLIDLVSQTVTLLAKISTPTPWDLYTAGSRAVAVAGEVAALLEPNFDRQALAAAYARLPIHAKKELALTGRDLITAGVRPGPEMGKLLHQVESQVVAGVLPNDPKKLLPAAIEMSRERQ

SEQ ID NO: 7177 - protein, 151 aa, Lactobacillus casei
MAEHVFEQLVFHFRNGDEWTVQHDELADVWISRVTTSYGRIHGGQIQEIHPCKSFKVEILPEADHVKSSDINTGSLEMGMFGRATKYQDIEKMDLVFDAEAKKQVQIYFPFKQKDPSGLDNEYQTSKLAKNGHLYIVIDAQHTVDDEYPRI

SEQ ID NO: 7178 - protein, 630 aa, Lactobacillus casei
MQTLTAEGLSKAYGDKQLFKQIDFLINEGERIGLIGVNGTGKTTLIRALAGLEALDAGTVKTPKNYRISYLTQVPDLDPDLPIMDAIYRGDSPVFQAIRQYERALAAYTKDPLNQAKTDAYTKADARMTQEDAWSAETDIKTILTQLHIDDLSARVGSLSGGQQKRVGLAQVLIESPDLLLLDEPTNHLDFDSIAWLEKYLSSYRGALIVVTHDRYFLDRVTNRIFELDRGRLFQYQGNYQAYVAKKADQLEAEKSANHKQAQLYRQELAWMHAGAQARSTKQQARINRFKELQAAKDDAPTPDQQLDPIQIASARLGKKVIEMNHANLSFGHHVILNDFNWLVQPGTRIGITGQNGAGKSTLLNIIAGKQKLDSGTISLGETVQLGYYTQMNTDLDPNKRIITYLQEVGEEVVQADGQRVSVTQMLEQFLFPRNMHGTLIGRLSGGEKRRLYLLQVLMRQPNVLLLDEPTNDLDIATLTVLEDYLDHFPGTVITVSHDRYFLDKVADQLLIFNGNGQIDRAVGEFSDYLAKQAAQPATPKAKPVATKPAPKKVAPKAKSKLTYAEKIEYDKLQQELDELDERLAKVKAEMADVNGEDYVKLGDLQAKIDKINQTIDQKFDRFAELDQYV

SEQ ID NO: 7179 - protein, 316 aa, Lactobacillus casei
MLEQPYLDLAKKVLDEGHFKPDRTHTGTYSIFGHQMRFDLSKGFPLLTTKKVPFGLIKSELLWFLRGDTNIRFLLQHKNHIWDEWAFEKWVSSPEYHGPDMTDFGHRRVKDLEFAKVYQEEMAKFDEKVLNDDAFAAKYGDLGLVYGSQWRAWRTSTGQTIDQLGDVIEQIKTHPYSRRLIVSAWNPEDVPTMALPPCHTLYQFYVNDGKLSLQLYQRSGDIFLGVPFNIASYALLTLLVAHQCGLKVGEFVHTFGDAHLYVNHIDQIKEQLTRTPRPAPKLVLNPDKHDIFDFEMKDIKLLNYDPYPAIKAPVAV

SEQ ID NO: 7180 - protein, 163 aa, Lactobacillus casei
MTEFLWAQDRTGIIGKDGHLPWHLPDDLHYFRAQTVGKIMVVGRRTYESFPKRPLPERTNVVLTHQADYQAPGAVVLHDVPEVFDYAKQHPDQDLVIAGGAQIFTAFKDDVDTLLVTRLAGSFDGDTKMIPLDWDAFTKASSRTVEDANPDLTHTYEVWKKKA

SEQ ID NO: 7181 - protein, 213 aa, Lactobacillus casei
MRVSKSSHYEFNNEMFSAITHAFALGLAVMGTVLLGVKGVHSGNRIELFSLIGFGVSLMLLYTASTAFHGFYFSKARHVLQVLDHSGVFILIAGSYLPYCLVAIGGKLGTGLLIAIWALCLGGIGYKLFFLNRFKHLETMIYVVLGWLCVIGMVPLWHHLGPVGFSLLVAGGLAYTGGAMLYLQKGIPYIHVIWHLFVILGSLCMYLSIYFYL

SEQ ID NO: 7182 - protein, 293 aa, Lactobacillus casei
MTVDEPNRKRGSDMANIKIVTDSSVQLTPEEISKYHITVVPLTIMIDNTVYIDGETITREDFMDEMAAAHNLPKTSQPAIGTFTDVFDKLTADGSQVLAIHMTETLSGTVNSARQAAQLAKGKVTVVDSLSTDRGLAFQVLAAAEMAEAGKDLQTILNKIKQIRDNTTLVLGVTSLDNLVKGGRISRVSGLISSFLNIKVVLQLKDGELSALRKGRGMKTINNFITETISQMAKMPNIKSVGISTAGATELGENVGRRIAEVLPSVPVLVRPTDPVIATHTGPGALAIIYYVD

SEQ ID NO: 7183 - protein, 281 aa, Lactobacillus casei
MAKLKNIFIACSVVLIACLLAFGGWQLFGPATDPSEVKVASSTPKQIQLTAVGDSLTYGVGDATNNGGYVGLTKSDLEATGQYQVTTKNYGVSGDTSTQILNRINKQAKIRADLKRANIITVTAGGNDLMHVLQKHFLTLSEKQITAGSAAFQKRLTTLLTTIRKENPSAPIYVFGIYNPFYVYFPKMTAMTNSVTAWNQATQKTLHQFKDVYYVDIDSVLSSGDTAANKASAKEALKEATSGEGNPLIFSQDHFHPNNAGYAQMTKQLMKQIQATKKEWE

SEQ ID NO: 7184 - protein, 213 aa, Lactobacillus casei
MEAKKRSRQRNTPQPKKIRTGINWWKWLLLVLVGLLLGTGIWFTKTILTPVNINTTAKTATTTNEPVFTVKLTKASANRIMAHYLKNYLRDSNVKYAVTLGTNEAALSGKFKFLGNSVKFQLTFDPLVLKNGDVLLKAKDLNVGALPVPISFVMSYIGNSYKIPRWVSLNSKAGTVVLKLSQFKLQNGMTLKATKLDLTNDDLEFAVYLPDEP

SEQ ID NO: 7185 - protein, 172 aa, Lactobacillus casei
MKKETAIFAGGCFWCMVEPFEEQPGILNVVSGYTGGHVPNPTYEQVSSHTTGHTEAVEITFDADVIDYPTLLGIYWQQTDPTDAMGQFQDRGDNYRPVIFVKDEAQRKAAEASKAALEASGRFTDPIVTQIEPAKPFYPAEPEHQQFYAKNPRRYAMEHAQRQAFIDKNWKD

SEQ ID NO: 7186 - protein, 80 aa, Lactobacillus casei
MHRTFYEYLMTLRNPNDHGEIAEFAKNAFLDQSFPKQEKDYHRLSDYLELNGNYLPTLAIFDETYHDYLASESTGGDSNQ

SEQ ID NO: 7187 - protein, 489 aa, Lactobacillus casei
MKRTTTIWPAKAQEAIPINKHKVPLWAVILIFVVALGGGAVGGYALSYQQAQQSVLKTGVPKALAPVVSAYETVTNNYYKKVNTTKLTDGAIKGMLGTLDDPYSVYLQNNDKTDLDDTISASFGGIGATIQQNHDSLSIASILPGTPAKKAGMQVGDVLLKVDGKDVAKKTVTQAVDKIRGKIGTTVAVTVKRGNKQATFSMKRKKITVDTVTGKLAPENKQVGVITISSFSEPTVKQFKATVKKLRKEGAKSFVLDLRQNPGGMMTAALSISSMFSKNGQTVMQIEDRNGAKEVYKAGKKLDGGFKITEKTAVLIDGNSASASEITAAALHQNRNIPLVGEKSFGKGTVQNVGEMGSNKELKLTVAKWLTPNGTWINHKGLTPDVKVDYPAAAKITLINATQLKPGDKGSDVKSLQQMLTALKVGSVNVNSQYDDETQAAVKSFQQANKLDATGTADQETLAALAQKLSDQLTKDDPMVKAAVQEVTK

SEQ ID NO: 7188 - protein, 254 aa, Lactobacillus casei
MTKAKGIVIKNNLAEAMERCHFSVNSLSIFSGVSRSRIAALQKNRNLNVTLQTAVPLARTLGLPFYEIFTSEQSFRSHWEFDSKRLDSLRKLAEEEKIKLKLSPYSQGNALNLETKYASNRRVSFSGNFHTASKYSVRVLQIIDFDVDRRDSEVSLEERDKMVKQMACVVAKFAKLNQIGIILVRLMTPGIRINAAPTIASLQRQLNKSRLLDTYFLNDYRSFYSLGFRVNSKSVRNRFLNFDLTLEKKIRIFE

SEQ ID NO: 7189 - protein, 111 aa, Lactobacillus casei
LIELEGFAVHPDKIARAQEWMAFLKSHQETVNATLVPEHITVERIFSLSFNDRMYLCWYSEQTAPSPDVTESPNSIDKVHVAFWHECIDESIPSMKFRLENEFVNPNLIGK

SEQ ID NO: 7190 - protein, 236 aa, Lactobacillus casei
MDQQETFANKVLAFSESLKHVSIDLPRNYRIVNPFSGAQKNAVNKTVTTFYKRYFNDTKPRRLILGSSPARRGTAITGVPFEDEDELKKETGITVNEFRVNRGSSSFLYGVMDKYGGKDKFYKDFFLSFVCPLGLIKINEKGNEVNCNYYENRRLQRELLPFIVNSLRTQIKFGVNTEVCYCIGSGENYKALNEINQKEHFFESIVPLEHPRYIMQYNSRNKDFYMGKYISALSRT

SEQ ID NO: 7191 - protein, 32 aa, Lactobacillus casei
MVDFAIAVWILSKAYLNYVKARQILKKPARKN

SEQ ID NO: 7192 - protein, 285 aa, Lactobacillus casei
LAIQWFPGHMAKARKQVQEKIKQVDLILEVVDARTPESSRNPMLDEIIGEKPRMVILNKQDLADPALTREWVQYYQDQGFAAIAIDAQHAKRLQQIPQLATKLMAEKIARKKARGIRNPMIKAMCIGIPNVGKSTVLNRLVHRNIAVTGNKPGVTKNQQWLKASDNFQLLDTPGILWPKFASQTIGMRLAFTGAIADAVFQEDVVGLYGLTYFMANYPDALKKAYHLTDTDLQAAPHDLLVKLTKTQGFGEEFNRMAERLIFDARQGKLGRFTLEKPGETDADTE

SEQ ID NO: 7193 - protein, 252 aa, Lactobacillus casei
MPTLSEYKALLQADHVDPAILTALKNDSRIGAGKLLAAYQRREDHRAAEAVALKYRSRYERQLWGTYQYVAGLDEVGRGPLAGPVVTAAVILPHHFRWPVNDSKQLTAHERNVLYPHILTEAIAVGIGVADNREIDRENIYHATELAMAKAVSHLRVAPEFLLVDAMHVPVDLPQERLIKGDANSISIASASIVAKVIRDRLMVMYDQVYPGYDFKHNMGYGTKAHLAGLAAHGVTPIHRRSFGPVRDCLNS

SEQ ID NO: 7194 - protein, 271 aa, Lactobacillus casei
MTLRDFLLTWHLVTHQNPRLAVALEEAIRAKTDLTAFQRELDKKMIQSAEPLLAVARQSAYVTYVDAAYPPRLREIPQPPLVLFYRGQIKLLQQLTLGVVGSRKATGYSAAALAQLFPQLPMMTIASGLATGADSTAHEAALTAGLPTIAVIANGIDQVYPAKHRLLQERIGRAGLIVSEYPPGTAPQRFQFVARNRIIAGLAHGVMVTEAEIKSGSLITANYALQHNREVFALPNRFGERLGAGTNALIQAGAAIVTGPDTLIENLHYYP

SEQ ID NO: 7195 - protein, 694 aa, Lactobacillus casei
MADKKLVIVESPAKAKTIEKYLGRTYKVVASLGHIRDLPKSQMGVDVENNYEPRYISIRGKGDVIKSLKKDAKKASRVYLAADPDREGEAIAWHVSHILGLDPQAKNRVVFNEITKDAVKNAFKAPRGIDMDLVDAQQARRILDRLVGYSISPLLWKKVKKGLSAGRVQSVALKLIIDRENEIKNFIPEEYWSLDAEFQKGRSKKFTASFYGIKNKKQALKNNEAVQKVLSQVDKTKPFNVTKVVKKERKRFPAPPFTTSTLQQEANRKLGFRTRKTMMLAQQLYEGINLGGKLGTVGLITYMRTDSTRVSNVAKTETSHYLHEKYGEAYAAVKIRQGKLQEGAQDAHEAIRPTSTLRTPESLASVLDKDQMKLYRLIWSRFVASEMTPAVIDTVAVTLDQNDVTFRANGSQMKFEGFTKLYVSSRDNDEKDNVLPPLAVGDAVKMLKTDPAQHFTQPPARYSEANLVKALEENGVGRPSTYAPTIETIQKRYYVKLNARRFEPTELGEIVNSLIVEFFPDIVNIKFTANVESELDSIETGEANWVKVIDQFYKPFEKEVAHAETGIEKIQIKDEPAGFNCDICGAPMVIKMGRYGKFYACSRFPDCRNTKAIVKEIGVICPKCHEGQVVERKSKRNRVFYGCSRYPDCDFVSWDKPVGRDCPVCGHFLVEKKTKAGTQVVCPNNDYKEALQKA

SEQ ID NO: 7196 - protein, 439 aa, Lactobacillus casei
MPIVNVIGAGLAGSEAAWQIAQTGVDVNLYEMRPVTMTPAHHTANFAELVCTNSLRANQITNAVGLLKEEMRRLDSIIIQSADATAVPAGGALAVDREPFSQLVTQKLMAHPRVHVIHEELTDFPEGVTVVATGPLTAPGLADAIVALNGEAGLSFFDAAAPILDASTINTDIVYKKSRYDRGEAAYLNCPMDREEFQAFYQALISAEVAEGHDFEKMTVFEGCMPIEVMAKRGIKTMLFGPLKPVGLEDPRTGKTPYAVVQLRQDNAAASLYNIVGFQTHLKWGEQKRVFRMIPGLENVQIVRYGVMHRNTFMKSPAVLEPTYASKRRADLFFAGQMTGVEGYVESAASGLIAGTNAARLAQDLPPLVFPETTAMGAMAHYITHTSPRHFQPMNANFGIMPPLAVKVRQKKERNQQLAERALTDLAAFKTELRRVNQL

SEQ ID NO: 7197 - protein, 298 aa, Lactobacillus casei
MKPIAAFQEYLTVERQYSPETVTAYLKDIQEFQAFLKANGGFTDFNKVDDLDVQTYLTDLNKQGLARTSIARKISSLRSFYRYLVRIDAVKRNPFELVELKKQHHHLPQFFYEAEIQELFKTVEGKTPLDQRNRALLEVLYGTGIRVSECANLTLNQVDFNTGLLLIHGKGNKDRYVPFGQYAQRALQTYLKDGRHTLMQKHQTQHRVVFVNQYGRPITARGIEYILDQLIKQTSLTANIHPHMLRHSFATHMLDHGADLRTVQELLGHASLSTTQIYTHVTMAHLKNEYMKYYPKHH

SEQ ID NO: 7198 - protein, 174 aa, Lactobacillus casei
MTTIAAVRKDGVTALAGDGQVTLGEKVIMKGNAQKVRRIYHDQVVIGFAGGVADAFTLQDWFEKKLEHYAGNLRRSAVALAQDWRKDPTLQKLEAMMIVMDEHDLLLVSGSGEVIDPDEDVVAIGSGGNFAQAAAIAMLRHAPDMTPADIAKEAVNIAGNIDIFTNHNIIVESF

SEQ ID NO: 7199 - protein, 469 aa, Lactobacillus casei
MVEVQTPKQIVEKLDQYVIGQDDAKRAVAVALYNRYRRMQLSPKMQEEITPKNLLMIGPTGVGKTEIARRLAKIVDAPFVKVEATKFTEVGYVGRDVESMVRDLAETAVAMEEEKQFKKVRVRAEKEANKRLVKILVPAIRKEKNSNPMAEMMNMLQGMQNGKTPAADDADAGGEVTDDIRNKRLSVAEQLEKGLLEDREITVAVNDEKKGGGMSDMYGQMGIDLSDTIGALMPKKKVERTMTVKEAREIFIKEESDKLVNHADIYHDAIQSAENNGIIFIDEIDKIAAGDKHTSGEVSREGVQRDILPIVEGSQINTKYGPINTDHILFIGSGAFAEAKPSDLIAELQGRFPIRVELKDLTEKDFVRILTEPDNALIKQYIALIGADGVKITFTKEAVNRIAEIATQVNHDTDNIGARRLATILEKLLEDVLYEGPDMAMGSVTVTQQYVDDKIGHIAADTNMTRYIL

SEQ ID NO: 7200 - protein, 292 aa, Lactobacillus casei
MVTIANDFLTVDISRHGAELTSIKDNLTGRERLWQADPEVWPRHAPVLFPIVGALADDQYHYAGKTYHMTQHGFARDRDFTVVSATPFKASLVLKDDDKTRAMYPFAFRLIITYALENNNLHVTYHVDNPDKTAPLYFSVGGHPGFKVPMTADTQFTDYYMNFKPRKSLVQIPLVAGKGVDYPHRTLAATDANLALTHETFKNDALIFAPLGKTSFNLLSDKTKHGVSVTMTDTPYLGVWSPYPKTGEFVCIEPWWGIADTIGTTGDFTKKLGINRLEPGTAFEKGYTISIF

SEQ ID NO: 7201 - protein, 207 aa, Lactobacillus casei
LVLVLCFILAYFIGAIPFGVVIGKVFYHTDIRKGGSHNIGTTNAYRMLGPVGGTLVLLLDILKGTLSASLPILFGIDHHWLILIVGLAAVLGHTFSIYIHFKGGKAVATSAGILLAYNPEFFFIAFAIWFSLILLTSMVSVASTLGMVIITCWSLVYHDWLLTTVACGLLVVFFIKHRANFKRIKAGDENMVPFGLGLYLRQHRRQQ

SEQ ID NO: 7202 - protein, 670 aa, Lactobacillus casei
MDKATQAYNDSSIQVLHGLEAVRKRPGMYIGSTDGRGLHHLVYEIVDNSVDEALAGFGDEINVTIHADNSVTVQDHGRGMPTGMHPSGKPTIEVILTVLHAGGKFNQNSYKTSGGLHGVGSSVVNALSESLTVRVVRDKRAFEEHFINGGHPDGGLQKLGKVNEPNGTTITFKPDPTIFQTTVFNYDTLAERLRESAFLLKNITINLIDERTGKQDQYHYPDGLVSFVKYLNEGKDALSQVINFEGKKDGIVVDFAGQYNDGYSENIISFVNNVRTGDGGTHEIGLRSGMTRAFNEFARKVGLLKDRDKNLEGSDVREGFAGILSVRIPEEILQFEGQTKGKLGTPQARTVVDGIVYENLSTFLMENGEESQELVRKAIKARDAREAARKARDDSRTGRKRKKDQGLLSGKLTPAQTKNPKRNELYLVEGDSAGGSAKQGRDRKFQAILPLRGKVLNTQKAKLQDIVKNEEINTMIYTIGAGVGADFDIQQANYNKIIIMTDADTDGAHIQILLLTFFYRYMRPLIDAGRVYIALPPLYRLQKGAGAKTKISYAWTDEELAKETKAMGKGYTLTRFKGLGEMNADQLWETTMNPETRTLIRVRIDDAQLAERRVTTLMGDRVEPRREWIEHHVKFDMDDDGSILETPTANHEKLQFGAKQIVKQLDKKGK

SEQ ID NO: 7203 - protein, 815 aa, Lactobacillus casei
LANQIQELTLEEVMGDRFGRYSKYIIQERALPDVRDGLKPVQRRILFAMNQDGNTYDKGFRKSAKSVGNVMGNYHPHGDSSIYEAMVRLSQDWKLRAPLIQMHGNNGSMDGDPPAAMRYTEARLSKISKEMLADIDKETVDMVLNFDDTAQEPTVLPAGFPNLLVNGATGISAGYATEIPPHNLREVVNAILYLLKHPQADLNDLMQYVKGPDFPTGGIIQGLDGIKQAYETGRGKIVVRSRTHIETMRGGREKIVVTEIPYDVNKALMIKKIDELRLNKKVDGIAEVRDESDRFGLSVVIELKKEADAQGILNYLFKNTDLQITYNFNMVAIADMQPKLLGLKPMLEAYVAHRRDVVTRRTRYELNKAQARQHIVEGLIKMLSILDQVIAAIRASKDKGDAKRNLVKQFDFSEAQAEAIVSLQLYRLTNTDITALQNEAAQLAKAIAGYQDILARPAARDRVIEQELKRIAKEYGDDRRSSIQAKIETLEVATTVTVADEPVMVQVSRDGYVKRSSLRSYQAVDPDDNGLKANDLAIFTGELRTLQHLYIVTNAGNIIYRPVYEIGDARWKDTGEHLSQTVGLGTDEKVLAVFAFDQLDIAGSFVLGSSDGYIKQTALSDLQPQRTYKRKPMLAMKLKTAGAVVTNAYFTTDQSQDVFVVSHHAYGLTFPLADVSTVGARATGVKSMDLKPDDEVVNFILVKNPQSAVVGILTQRGAFKRMALSEVGEMSRARRGLLVLRELKRDPHRIVAMMAVDVNTRLDVLTDADKVVTLTPSQHPTGDRYSNGSFVIDTDVQGTPVFVRTREEIPEKNEQ

SEQ ID NO: 7204 - protein, 753 aa, Lactobacillus casei
MKQLDETKVPNYWEGFNGGDWQEEINVRDFIEHNLNQYDGDESFLAGPTEATTVLNNQVLNLKKQERANGGVLDADNNIPSTITSHGPGYLNKDLEKIVGVQTDKPFKRAFMPFGGIRMAEDALKAYGFETDPAEHKIFTEYRKTHNQGVFDAYTPEMRKARHYKIVTGLPDAYGRGRIVSDFPRIAIYGIDRLMEEKVNDYNLTGDGEMTDDVIKLREEINEQYRALNDMKKMAKEYGYDISRPAANAQEAVQWIYFGYLAAVKTQNGAAMSVGRIDTVIDAYIQRDMRLGKLNEEQAQELIDHLVMKLRMVRFIRTEEYNSLFSGDPIWATLSLAGMGNDGRHHVTKTAFRFLKTLDNMGAAPEPNITLLWSERLPEGFKRYATEVSIQSSTIQYENDDLMRNEWGTDYYGIACCVSAQPIADGVQYFGARANLAKTVLYAINGGKDEIQEAQVGPEYEPITSDYIDYDEFMKKFDKMMDWLADVYVNALNVIHYMHDKYYYEAAQLALKDTRLNRTFATGISGLSHAVDSISAIKYGHVKVIRDENGIAVDFVADNDDYPRYGNNDDRADNIAKWLVKTFYNKMNTHHLYRGAKLSTSVLTITSNVVYGKNTGTTPNGRQKGEPFSPGANPAYGAEKNGALASLMSTAKIPYHYATDGISNTFGVTPNTLGHDDETRKDTLVHMVDGYMENSGMHLNINVFNKETLIDAQKHPEEYPTLTVRVSGYCVYFADLTKEQQDDVIARTFFDEM

SEQ ID NO: 7205 - protein, 283 aa, Lactobacillus casei
MKLIDQSQSPLNILEQVGQDHEGPIKGYVHSVESFGSVDGPGIRFVVFMQGCRMRCQYCHNPDTWNIGVGEEMTADQILADAQRYKAFWGEQGGITCSGGESLVQIDFILELFTKAKELGISTCLDTSGGPFTRDQPWFGQFEKLMAVTDISLVDIKHIDSAEHKKLTGFPNENILDMVQYMSAHGDDMWIRHVLVPQRTDFDPYLKRLGDYIATLDKHVVQKVEILPYHTLGVKKYHELGITYPLEGIEPPSADRVKNAENLLHVQDYTGWQNWRPRPATKA

SEQ ID NO: 7206 - protein, 322 aa, Lactobacillus casei
MKTKQERIFSSKTLTYFLQLAETMNYTQSAQLLGITQPALTQQIKKLERTVGAPLFYSVGKKLHLSDAGQTMLKATHEIYEILNQTTDEIQQSTSATVGKINIGLLSSIEDSAFNAFIAHYYDLNPEVEITLRMMTRHEIWEALENNQVDLAIMNLPDETIKNWKPYASKKILDEQLLFLHHDDSLANRKRLHFKDTLAEPWVTYPDDYFLGQMLHEAYKNQMVDFPHVVAHFTTPYQLTQFVNHTGVNTALPTSFVTAHADQIKAHAVSFEPAIRFETSFVYRKEKADIPRIANFFKTFDAYLAEKDYLSRVGENSGKIER

SEQ ID NO: 7207 - protein, 310 aa, Lactobacillus casei
MTTLIFGHQNPDTDAITSAMSWAEFQKQAGNTDVEAVALGEPNDETKFVLDHFKVQAPRVIKTAANETDTVMLVDHNEFQQSVADIEDVQIASVVDHHRIANFHTAAPLFYRAEPVGSTNTVIFELFQEHGYTISPTLAGLMASGLISDTLLLKSPTATDKDKKILPEMAKIAGIDLQSYGLAMLKAGTNLAAKSDMDIIEGDAKSFTMGGKSIRIGQVNTVDLDDIYARQDDLLNAMTKEAQAKGYDDFLLIATDILNSNSTGFAVGADRDKVAAAFNEKFDTNARLALPGVVSRKKQVVPPMQKVFEG

SEQ ID NO: 7208 - protein, 373 aa, Lactobacillus casei
LSTQNYPKLIHAMLPSLPDYIQDYYHSQKAIPIADSTLYQYLHFYQEFLEWLITSGVTTATSPQSVPLETLEHLSLRDAQAFMAYLLERPSKTHPNKRMTRRSVALRLVGIKALYRFLTEESEPHEDGEPYFYRNVWNKVKLKTHAETTAYRNHKLQEMLFVDGEDAKFLHWLDQVYAHQLPSKQRAYFNAAKQRNLAIIALLFGSGVRVSELVNMNLEDLNMDRHTVQVVRKGNFQDRVNFADWIDPYLTAYLQQRAAIIAYQKPTSPLFVTQVGQTVKRIRQNTIEAFFKRYTTAYGRPSTPHKARHTLGTNIYTVTKDVQQVADQLGQTTTSATDLYINLSDKRGKAALREVSETAAKALDRHTQQPHEN

SEQ ID NO: 7209 - protein, 117 aa, Lactobacillus casei
VLDVKDSVNRLAWTTEHHFLHIQARHDFMRAWAVQFEMAYTDFRVIQMALQLGGEQYHDLLKRFAAAYEAVYPFEYAFAAGGLAGFDEQFADKMADYQTAEQNLLKLIAEIKALQPA

SEQ ID NO: 7210 - protein, 661 aa, Lactobacillus casei
MKFYFKLAATNLKADRRLFVPFVITTSFLMAINLIMLNAYASSDVLFSEFGASAGRSLFMFGSVITAIVSVILVIYANNFLRKQRIRQLGLYNIIGFGKGELSKMMAIEKLLLLLATLLLGGALGTVLSRISYLTLAKVLHVNHHLEFGLSQQAFSIAGIITIGLFIILMFIDEIWLIRKQPIDIVREQSAGEREPKIAWFTLIFSLVCLIAGYTLAVVITNPLEAMSMFFFAVILVITGTYGLFTSGSVFVLKWLRRRKNYYYQPKHFINVSNLLYRMQQNGAGLASIAILVTMTLITLATTATLFFGINEIVNAQTPVDLSYSLKTNDAEAANRVTELAKTHHVRIRSIRTFTGPSSTLALLEKNRLNSQSSINGPFGFDNARSVQLMTIANYNRYTGQHRSLNGNNILIYTSNHFAGNTLTIGKQTYHVATRVSSFPNAPKTFIPNLFVAFPSETQMLAALHHLYPKKTMAELKTDVTTNQDLMLSGSHVNQTKLYQDLNKSGIALPDTVQSRAVNYDDTASMMSSFLFLGIVFGATFILATLLILYYKQLAEGYADERRYTILQRVGLSLREVRSTINSQLLMLFYLPLVVAAIHVGFALPFVQRIMMLFGLPDWQFFLTVSLITLAIFAVIYVLMYRLTGNVYYRIVSRRQPTSRR

SEQ ID NO: 7211 - protein, 256 aa, Lactobacillus casei
MSTLLKLKNVEKTYTSRGAQPVQALVNISFTVESGEFVAIMGESGSGKSTLLNLIATLDNPTGGEITLNGQDLRKVKEGARAKFRREHLGFIFQDFDLLDTFNVQDNIFLPLVLAKKPLAVMNERLAKLAPRLGISDLLQKYPYELSGGQQQRVAAARAMITEPEILLADEPTGALDSKTSSELLDLLTDVNAQSQQTILMVTHSAIAASHSKRVLFIRDGQIFHQLYRGELDQPEFLTRISETMTAMLTKEGEGQ

SEQ ID NO: 7212 - protein, 116 aa, Lactobacillus casei
LPTVVSDSQWLRFIFEQLLTNAIKYTPRGSIRIYAKGDAVFVADTGIGILPEDLPRIFEQGYSGYNGRATQKASGLGLFLSRQIAEKLGLRLTVTSKVGVGSTFAIHFPQTRWLAE

SEQ ID NO: 7213 - protein, 201 aa, Lactobacillus casei
MIKAYYHARWMVWLSLLTLLLTGLLANWLVNVSIEVILNMWLFALIPLLVIGGYDLWRFNREWQQLQADVSLLDDTQITDPLGRAYYQKIQSLQQTVRKNSDTYRDREQEMLDTLQLWTHQIKTPLTALDLLLQVEPVNANDARLEISKINRYLTVMLNYLKLTTLNTDLVLTEVALKPLVNETVRDLAKLFIAKDLTVSV

SEQ ID NO: 7214 - protein, 231 aa, Lactobacillus casei
MPQKIFIVEDDDVIAKTIANYLNRWAFTVSLVKKFDQVDEEIRAAAPDLVIMDISLPYFNGFHWLSELRKHSNVPVIFLTSSGDDMNLVMAMNLGADDFLAKPIELPVLLAKIQGMLRRTYQYQQTETNLTHDDFTLVPTDNQLRSPAGVLDITPTETKLLSLLFSANGEVVTREAMIEKLWEGDEFIDRNALAVNMNRLRKKVAPVGLAQLIETVKGKGYRLASKEAGHD

SEQ ID NO: 7215 - protein, 400 aa, Lactobacillus casei
LGQSKIGWQGQTAAFLLSQNLFVFGTSTVFFAVLWDIALKTSSGAWMTYVSLATSLPAILISLSAGVLADRYNRKWLIVLSAVAVTVLTLAVAYVFAFVTQELWLLLVIAVIRSFGNGLENPAANALLPQLVPAKQITRVNGYNQILMAAMLVMSPLLAGYILSDLGIFWIFVIDALTAALAVLCLGVVHVPTPTARRDRASKRQNGILAGLRYVGNTPLLLAFMLFTGAAFILIAPSSQLSTLYVNRTFGSEVWHLTFNEWSWTIGAGLGGLFIARHKKFRDQLGLIAIGFAGSGIAFAEMGLKQPFITYLFFMFISGIFYPLIQAGQTIYLQENVPADKLGRVFSLWAILSTGIYPLAMLAYGPLADWVPIGWIFIVTGLLLIGVAYWFWQRLKKLSW

SEQ ID NO: 7216 - protein, 211 aa, Lactobacillus casei
MLENNNFDEVVMKRHTAREFDPEITISKGELLQMITYATKAPSALNMQPTRFVVAQSNAAKEKIASVAGTNAPEILSASAVVLVGGELDLGPFEAELFKRAAAAGLLTDRAVEHQKPMIENLVASFQTDKQALREFIIQNSSLSAMSFMLAARAYGYETGAMTGFDHEKILPALDLDPEHFMPTLLIAVGKPKNAPDSLYRIPASKVTFFK

SEQ ID NO: 7217 - protein, 265 aa, Lactobacillus casei
VKIANIGGQPHLITSASTAQPITNAPEVLTALTKPASLTLGPTFQFTADQLEAPITTSQQIFAIGMNFLDHSEEIHIKLPTVPSVFTKFSSSLAKPTATVRMHGPKTDWETELVVVIGLGGRNIPEGEAMRHVAGWMVGEDLSDRAVQFANAEPQFSLAKSFQNYSPIGPWVTSPDEIANLDRLQITTTVNGQVMQQASLDQLIFKVPTLIHYLSGIVALQPGDLIFTGTPSGTGVGRDPQVFLKPGDQLTAAITELGALQLTMA

SEQ ID NO: 7218 - protein, 34 aa, Lactobacillus casei
MSVYQDHVLVHRLASPKINSSTTANTFGTTIFQK

SEQ ID NO: 7219 - protein, 362 aa, Lactobacillus casei
MLKHTVKHLQPYTPEKPLADLKKELGLTSLIRMSANENPFGTSPEVRQAVANWDFTQSRDYPDGNASQLRMAVADHLHVASEQLVFGNGLDEVIALIARTFLEPGDEVVEPWPTFSEYRLHAEIEGAKVVDVPVQPETGNFDLAAMVQAITPRTKLIWLCNPNNPTGTLLSLTALTRFMRQVPEDVLVLVDEAYIEFTDDYPATSAIGLLPQFDNLVVLRTFSKIYGLANFRVGFGIFPKQLVSYLQSVRLPYNLSTIAQLSAQAALADQGFVQITRSRVRQARRSWETFLTDRALPHYLSQTNFQFFQAPQNQAQSLKQELLQHGFLVRDGLMPGWLRVTFGTASQNQAVQQVIQAFQANL

SEQ ID NO: 7220 - protein, 110 aa, Lactobacillus casei
MTAAKQSITELYDLIKDRQAQPIPGSYTDYLFTKGLDKILKKVGEESTEVIVAAKNPDDAAFVLEVADLTYHVLVLMVERGITLDQIEAELASREGKMSRLKERSSINKY

SEQ ID NO: 7221 - protein, 107 aa, Lactobacillus casei
MIALDFKKGSGLITTVIQDARTQQVLMVAYMNAESFEKTLETGETWFWSRSRQMLWHKGETSGNIQRVQSIAVDCDADTLLISVLPAGPACHTGHTSCFYRTYARKE

SEQ ID NO: 7222 - protein, 252 aa, Lactobacillus casei
MLTKRIISCLDVDQGRVKKGVHFIQLKDVGDPVAIAKAYEAQGADELVFLDITATTDARQTMTQTVAAVAAQVFMPLTVGGGIRSVADMHDLLRAGADKIALNSAAVKQPKLITAGAETFGSQAVVVAIDTRWQAERQRYQVTINGGRTPVDLDAIQWAKQAVAAGAGELLVTSMDADGTQEGFDLALYRQLSAAVTVPIVASGGAGSAEDFVALFKETAVSAGLAASIFHFGQLTIPEVKTVLKQAKVAVR

SEQ ID NO: 7223 - protein, 249 aa, Lactobacillus casei
MQLYPAIDLLAGKSVRLTQGDYQRVSLSADPLDQVARLNAAGLTRLHLVDLDGARAQQPINQAAIKTIRQHTSAFIELGGGIRNLATMNEYLTAGIDRLVLGSVAITDPEMVEQAIAQFGSRRIVVGIDVRSGKVATNGWLTTTRQNALAVMQTMQTAGVQTVIVTDIGRDGTMQGPNVDLLRTLQHAIPEINIVASGGVRTLADLTVLRTADIHAAIIGKAWQTGAIELNKLKELEDDDADQTNYFMP

SEQ ID NO: 7224 - protein, 208 aa, Lactobacillus casei
MIVIVDYDTGNTLNVKKALEYLAIDNQLSADPAIIMAASGLILPGVGAFKTAMNALQQRHLVSVIQAFAATGKPLLGICLGMQLLFDRSEEFGETQGLGLIPGQVVAIPTKEGISIPHMGWNTNTLTQDDPFAAGFANQATYFVHSYYVQTKSAYTLATTDYGQPLTSIVRRQNILGTQFHPEKSGAIGLAGLQRFKEMTDHATLSSH

SEQ ID NO: 7225 - protein, 194 aa, Lactobacillus casei
MRTATITRTTKETQITISLNLDQQSGIAIDTGIGFFDHMLEAFAKHGRFGLTIKAQGDLDVDPHHTIEDTGIVLGNCFKQALGDKAGIERFGSAFVPMDETLARVVVDLSGRAYLVFDAELTNQRLGGFDTEVTEDFFQAIAFAGEFNLHAAVLYGRNTHHKIEALFKALGRSMQAAVAENPAVKGIPSTKGVI

SEQ ID NO: 7226 - protein, 426 aa, Lactobacillus casei
MKILTGTLTQLQQQVAAREQNLTQNTAVQTTVQEILANVKAKGDAALRNYSKQLDHVSIDDLRVPQATIDAALANLSPKLLTALNLAKTNITSYHQLEISHGFIDSPSLGIIRGQKVTPLDAVGLYVPGGTAAYPSTILMTAIPAKLAGVKKIVMVTPPQKAGLNPVVLAAAKLAGIDEIYQIGGAQAIGALAFGTETIPRVDKIMGPGNQYVAEAKKQVFGAVAIDMIAGPSEIGIIADDSANPVRVAADLLSQAEHDPNARAMLVTPSEKLAEAVSDQVEIQLATLPRAAIARTAIRNQGFIAVVTDTNAAFTLMNTIAPEHLEVQLPDPITYLNRIQHAGSVFLGENAAEPVGDYVAGPNHVLPTAGSARFFSPLGVYDFVKRTQFIQYSSEALARQADAIVTLARTEGLDGHAEAILKRTAR

SEQ ID NO: 7227 - protein, 209 aa, Lactobacillus casei
MTLTIALAKGRTTEQVLPLLSAAGIDCMPLQEKSRRLLFTDDPDFHFVLVKAPDVLTYLNRGTVDIGIVGSDILEEQGHQQFDLLDLRTGRCRFILASTPDFDPYQTSRKRIATKYPHIAQSYFQTQGEDVEMIKIEGSVELAPLTGMADAIVDITETGTTLRENHLKVFATLTPVSTHLVVNRLALKQKKSAIYQLIQALKRVRPQEV

SEQ ID NO: 7228 - protein, 382 aa, Lactobacillus casei
MSNRHLPVGTRDEFGPRAIRKENLIQIMSRHFIDAGFDRVKTPLLEYRDVFQPLTVTGEQPYQMLDDAGETVVMRPDLTLPLARLLSTTNIQPPVHWWYVGDIFRVRKSLSGTYNQITQAGIELIGYASLKAEWACLNEAIRICNDLKVGDLTLELSDARFVPQILQALALDPETEAALQTAFFAKNLNAYERLIEPLAANALYPFLKQWPWLFGPAATVFEQLRQLLPPAFVGEQVTRLQITVDFLKDQFPDLNVTLDLTSQPPQSYYTGIFFHAYVPNRREYLFSGGRYDQLMASFQRDLLPAVGLAFDVDALTDTVQEPTASPQTFVYGLPSQWQEAAAVVATTPNARLCLVDSLAEARALAKSRHARLIDLSPKEATL

SEQ ID NO: 7229 - protein, 67 aa, Lactobacillus casei
MAKDQPSRPRPLTLRFLTGLAHAHAKKAPENVFTFSRATGDRGTTSILFRPHDPNLTYQPQVGLREL

SEQ ID NO: 7230 - protein, 365 aa, Lactobacillus casei
MLRKSIAGLPDYVSDSTPERIAKAAGLAKLTRLSFNENPVGTSPKVQEAIANWTFSQARSYPDPDAMPLRTAVAERLHIPADQLLFSSGLDEMIALICRTFLDVGDESLQPWPTYPEYQLQAAIAGAVTVNAPVDDTTGSIDLQALLAGITPKTKVIWLCNPNNPTGTYLPVSEIAEFMAQVPPEILVVVDEAYIDFVDQVANPSVLPLITKFANLLVMRTFSKLYGLANFRVGFSIVPKALIPKMQNVRLPYNISGLSQTAALAAWKDVAFTQKVKRQLFAARQQWTAFFDHHHIRHYATQTNFMLYQVAQPQALGAFLKQHGYLVRDSMVPGWIRQSFGTPEQDAEVQGLLLDFLKTTSPLAK

SEQ ID NO: 7231 - protein, 186 aa, Lactobacillus casei
MFFDQPLAKGKILSETPHYHGPIFNVVTQKIKTPDGLTVERDLIRHANAVAMLALTNDGRVLVNREYRVATNSEVFGLPAGLIDPGEDWQTAASRELHEETGYLTHDLQWLTAVRSSEGMTDETVNLVLANIDLAAKTSQDFDKDEFVTSRLVPFSELVEGVKAGKINSAQTVAAVTYYLAFVANS

SEQ ID NO: 7232 - protein, 288 aa, Lactobacillus casei
MKTAIVTDSTCYLPQAEIDKHHITVVPIPVILDGAVYDEGKDITTEEFYAKLKTAKTFPSTTQPPLGEMLKLYENLANEGYDTIISIHLASTISGFVNTLKGAVDEVHGAKVYVYDSQITVILMGWLVLAAAQMAEAGKDPEAILARLDDLRSTMGEYFIVNDLQNLVRGGRLSNASAFIGGMLKIKPLLTFDDQSHKIVAIEKIRSIKKAYARVETLFQQELERVDYPIRAVVIHANDPEEAQRWLTDLQQKFPTVPFELSYFGPVVGTHLGEKAIALAWMKDFTKA

SEQ ID NO: 7233 - protein, 90 aa, Lactobacillus casei
MTTSKHTTLAVVKMTSKHQITIPKAVREKLGLSDHDKLVFQLTDHGQVMIDKEQKSDLWSIIREQDAAHGSIDTPEPDWGKGVGAELIDD

SEQ ID NO: 7234 - protein, 566 aa, Lactobacillus casei
MSFDGIFTHAMAQELNGILSGGRVAKIQQPYENEVVITIRAGRKNHPLLLSANPQYARVQITHIPFTNPDVPATFTMTLRKYFNAATLTAVHQVQNDRVLHFEFSTRDELGDELGLRLIIEMMGRHSNIFLVSKRTGKIIDLIRHVSADQNRYRPLIPGAQYVEPPKQDKINPFDDRDRLYHELERQVTPTLSRAALLQQHYQGLAKDSAAELALRLNQGDAGWDGFFKELEAPAPTITTQGKKAVFTAIPYQSLSGDQQYYPTLSTMLDAYYEQKAEHDRVLQQGGNLIHVIKNIIDKDRKKQRKLKRTLEETEKADDYRVRGEILTTYLSQVQRGMTSIELPNFYADNQPIKITLSNQLTPSRNAQKYFAKYTKLRNAVAHVNQQMQENQEELDYLEGIMAQINVASPKDLADIRLELQQQGYLRKQKQKKGNKRQKVSKPDQFYASDGTKIWVGKNNLQNDQLTLHTAKKTDIWLHVKDIPGSHVIIDSSKPSEKTLLEAAKLAAYFSKARESANVPVDWIEVKKIRKPNGAKPGFVVYEGQKTVSVTPDAELVDKLRTPPTK

SEQ ID NO: 7235 - protein, 103 aa, Lactobacillus casei
MTNTSAQISRPIQEHIIANKVKHGWNTTDTNFEMLLAYHEMAELTTALLKRDQDNIAEELADVTIYLLGIAEIKGIDLAEAVNAKVAINDHRVYDAQGHKHLE

SEQ ID NO: 7236 - protein, 378 aa, Lactobacillus casei
MAGDSTTKGMPAAAETLADAPMQGERGSHATTTQAISMTVTAFINKVLSGTALGVIIGLIPNAVLSGILKYFGTNTFAVTLTQVAAIFQIATPLIIGGLIALQFELKPLQMMVTAGAAFVGSGVVKFNPATKAYVGAGTGDLINTMITASIAVLVLLWVKDRFGSTAVIAMPILVGCGVAYIGVLLLPFIAAFTTAIGDVINSFTTLQPILMAVLISCSFAILIVSPISTVAIGLAIQLHGVSAGASAMGVAATALALVVYSWKVNKSGVTIAIALGGMKIMMPNLFKHPIILLPCLFTAIISAIPVALLSISGTPQSAGFGIVGMVGPLAAMDAGLAIPLVLLCWIVIPVAAALLSKVLFEKMLKLFDSRIVFKFLG

SEQ ID NO: 7237 - protein, 213 aa, Lactobacillus casei
MTKLENQIASDLLRIKAVTLRPEEPFTWASGLKSPIYTDNRLTIGYPDVRSKIAAGLAQEIVAHYPDVTAIGGVATAGIPHAALVANLLNLPLVYIRSKPKDHGQGRQIEGHLPEDAKLVVIDDLLSTGGSVLSAVAAAQKDGVNVLGVAAIFSYQLAAVTANFAKAGLPFFTLTNYTALIQTAEAQGAITTQQLSSLHQWREDPAKWGDRFQ

SEQ ID NO: 7238 - protein, 239 aa, Lactobacillus casei
MTPIIALDFKDQATTLDFLARFPKDKRLFVKIGMELFYAEGPAIITAIQAAHPVDIFLDLKLHDIPNTVEKAAWQLGKLGVALTTVHAAGGKEMMLAAKRGLLAGAKAAHHPAPKMLAITHLTSTDQTMLENQLSIDVPLNQAVQHLAAIAQASDADGVVASALETPLIRSVTKPEFLVVTPGIRPQGDAIGDQKRVVTPGRAKRLGSSAIVVGRPITQAPDPVEAYQSIKKAWETAHD

SEQ ID NO: 7239 - protein, 289 aa, Lactobacillus casei
MIELPGFTMKNPFMPASGTFGFGEQYAKQYDLNLLGALVTKSTTLLPRVGNQGKIFADGPSSTLNAVGLKNPGSEVVLREKLPWLAKNYPDLPIIASIAGADVAEYAAVAKKLSAAPNVKALEVNISCPNVKQGGMAFGTDPVVAAAVTRAVKEASSVPIFVKLTPNVTDITVIAKAVEAAGADGISLINTLVGMRLDIHTGQPVLDNVTGGVSGPAIFPIALHLVYQVAHTVHVPIIGMGGVSSGHDAAEMLAAGAQAVAIGSANYYEEKAIPKIAAAFARIQEGQAV

SEQ ID NO: 7240 - protein, 1060 aa, Lactobacillus casei
MPKRQDIHKILVIGSGPIIIGQAAEFDYSGTQACLALREEGYEVVLVNSNPATIMTDTEIADRVYIEPLTVEFVSQILRKELPDAILPTIGGQIGLNLAMKLSNTGILDELGIELLGTKLSAIDQAEDRELFKNLMQKLHEPVPESAIANNVDEAQEFADKIGFPVIIRPAFTMGGTGGGIADNEKELAEIAENGLNLSPVTQVLIERSIAGYKEIEFEVMRDASDSAIVVCNMENFDPVGVHTGDSMVFAPTQTLTDKEVQMLRDSALKIIRALKIEGGCNVQFALDRNSFKYYVIEVNPRVSRSSALASKATGYPIAKMAAKIAVGLHLDEIKNPVTKKTWAEFEPALDYVVTKLPRFPFDKFENGDRTLGTQMKATGEVMAIGRTLEESLLKAVRSLEVGLIHPRRPAFAKLSDDELSKHIIQANDERLFYLAEAFRRDYTIDEVAELSKMNPFFLDKIKHIVELERELAAHKADLPLLAEAKRYGFADEEIAQLWGLHADQIRQMRKEQHILPVYKMVDTCAGEFASDTPYYYSTYESSTDSFKSDKPSVLVIGSGPIRIGQGVEFDYATVHSVKAIQKAGYEAIIMNSNPETVSTDFSIADKLYFEPLTLEDVLNVIDLEQPEGVIVQFGGQTAINLAEPLAKRGIKILGTSVEDLNRAEDRDLFDQVIKQLKLPQPEGGTATDKAGALAVADKIGYPVLVRPSYVLGGRAMEIVHDADELASYIDRAVSVSHDHPVLIDHYLVGKECEVDCISDGETVVLPGIMEHIERAGIHSGDSMAVYPPQTFSQDIIDQITDATIKLSRALNCIGLMNVQFIIHQGKAYVIEVNPRASRTVPFLSKVTNVKLAQVATLAILGLSLKEQGFKTGLLPNQAGIHVKAPVFSFSKLNHVDSLLGPEMKSTGEVMGSDTTLAKALYKAFEAAGMHLPQFGRALITVKDADKTEATELAKRFREVGYQLVATSGTAKAFEKAGITVETIEKLDSGKETILEDIADRKIQLVINTMTADKKTSSDGFRIRETAIEHGVPLMTSLDTADAILKVLESRAFSMTPIRS

SEQ ID NO: 7241 - protein, 360 aa, Lactobacillus casei
MKRYLILEDGSVFPGVGFGAETVTTGEIVFNTGMSGYQETITDQSYNGQIITFTQPLIGNVGINRDDYESIDPTAKGIVVREVARVTGNWRSQMTLDEFLKRKHIPGISGVDTRALTKKIREVGAMKASIVDAADEHAFDQLKALVLPKNQVQQVSTQQAYPAPGTGRTVVVIDFGLKHSILRELAKRQCNVTVLPATTTAATILELAPDGVMLTNGPGDPKDVPEALDMIRGIEGKIPLFGICLGHQLFALANGADTFKMKYGHRGFNHPVREIATGRIDFTSQNHGYAVDPDSIDPDTLLVTHVEINDGTVEGLRHRLYPAFTVQFHPDAAPGPHDADHLFDEFMEMMDAFSDRTQKG

SEQ ID NO: 7242 - protein, 424 aa, Lactobacillus casei
MLIKNAHIISDTEYTADIQITDDKITAIGQQLAARSDETVIDATGATVVPGLIDVHVHFREPGFTAKETIKTGAQAAAHGGFTTVVAMSNLKPVPDTVATLTPVLAKNRSDAKITVRQFAPITHDLHSDQLVDMPALLEAGALGFSNDGVGVQDADTMYQAMKQAAKLKAPIVAHIEDASLMHGGVINAGPVAEKLNLPGIINQTESSQLARDLDLAEATGVHYHACHVSTRQSVALIREAKKRGVHVTAEVSPHHLLLDENNIPGDNPMFKMNPPLRSRADHLALLEGLQDGTLDMIATDHAPHTAAEKSGSFKTAAFGIVGSETAFPLLYTKLVKSKMFTLKQLIAKMSTVPAGKFGLPGGHITVGGPADLTILDLDTTYTIDPADWFSKGKNSPFIGEKVQGQALYTISRGRIAYQKGGQA

SEQ ID NO: 7243 - protein, 313 aa, Lactobacillus casei
MTLSNLTDTPFKDFVSAEQVDEKSALALINRAEDFKAGQTVHFPEPIYAANLFFENSTRTHTSFEMAERKLGLTVIPFDPAHSSVSKGETLEDTIKTIGAIGVNIAVMRHSKDGYYKELMGAWPTTAIVNAGDGAGQHPSQMMLDLMTIHEEFGHFDGLNIGIVGDLSHSRVARSDMQMLHKLGATLHFAGPQQWYDPSFDRYGDFISVPDLVKQVDVLMLLRVQLERFNTDNREAFSKESYHAKYGITDALAKTMKPNAIFMHPAPVNRDVELASDLVDGPRSRIFTQMQNGVFMRMAMLEAVINARHFGEE

SEQ ID NO: 7244 - protein, 435 aa, Lactobacillus casei
MAFHNDEAVLDIGDKPKFGQWVGLSIQHLFAMFGSTVLVPILVGLDPSIALFSSGVGTLVYILITRGKIPAYMGSSFSFITIMQALMKGAGYPAIAQGTVAVGVVYLIVALIVARSGSAWIDRALPPIVVGPIVMVIGLSLAGTAATDATMRTISATKSVYDLRYFAVAMITLASVIIYNMYLKKFISLLPILLGIVTGYVVALLFGIVDLTSVQQAAWFDLPKFELPFISYKPQLYWGAILSMAPIAFVTMTEHMGHIMVLNKLTKRDFFKDPGLNHTLAGDGTASIIAGFVGGPPVTSYGENIGVLAMTKVHSVYVLGGAGMFAILFAFIGKLSALIRSIPSPVIGGISFLLFGVIASNGLRVLIDNKVDFDKKRNLMIASTILVIGIGNASLQFAGYQFSGLALATVIGIFLNFVLPEHAANEEGAEKNDLI

SEQ ID NO: 7245 - protein, 182 aa, Lactobacillus casei
MTQSKQVVDEVTMKRALTRISYEIIEQNKGLNDLVLVGIKTRGIYLAHRIAKRLEQLEGLQVPVGELDIRFYRDDVHKIDHEHQPDVEGAQLPVNITGKHVILVDDVIFTGRTIRAALDALMDEGRPRKISLAVLVDRGHRELPIRPDFVGKNIPTSLDEQIQVQVAELDGKDGISIEKMGD

SEQ ID NO: 7246 - protein, 306 aa, Lactobacillus casei
MTETFTITTEQGRIDKVITAHESTHTRSQVQKWLQDGLVTVNGQPVKANYKVSSGDVIAVSIPEARPLEAVAEPIPLDIVYEDDQVIVVNKPQGMVVHPAPGHPDGTLVNGLLYHTDLPGINGVIRPGIVHRIDKDTSGLLMVAKTEKAQLSLSAQLKAKTSIREYLALVHGTFKEDEGTIDAPLGRDPRDRKRQAVVADGRHAVTHFQVLERFAHYTLIKCVLETGRTHQIRVHMAYIHHPVAGDPLYGPKRTLPGNGQFLHAAKLGFVHPTSGKRLTFTAPVPEVFEKTLVDLRAGIDKTRNVR

SEQ ID NO: 7247 - protein, 155 aa, Lactobacillus casei
VFIYVIVAAVLVLIDFVIKTWVSAHIPLGESQQLIPGVIDLTHIRNTGAAFSMFEGKQWFFYVTTVLAFVVVALLWRDSLHKPVYRLGLTLITAGAIGNFIDRLRFQYVTDMFHLEFLDQWRFNAIFNFADMCITFGVILVLLFILFDRDKAVSA

SEQ ID NO: 7248 - protein, 557 aa, Lactobacillus casei
MSDIEIAQANEATSMWPITKVAANLGLTDDDLELYGKSKAKLSFAALNALKDKPFGKLVLVTSINPTPAGEGKSTITVGLGDALQQRGQHPVIALREPSLGPVMGMKGGATGGGYAQVVPMEDINLHFTGDMHALTTAVDTLAALIDNHLQQGNTLNIDPRRILWKRALDINDRALRHVTIGLGGPTSGVPREDGFDITVASELMAVLCLAENIADLKARISRIVIGYTYDRKPVTVADLKVTGAIAMLLRDALKPNLVQTLEHTPAFIHGGPFANIAHGCNSVLATRTALQLGNIAITEAGFGADLGGEKFMDIKTPVLGKTPDAVVIVATVRALKYNGGVALADLQQENLDALAQGFANLKRHIHSMQGYGVPVVVAVNRFTSDTDAEVQWLIDACAKLNVKAVTATVWADGGRGGLAVADAVLDALKQPASFTPLYDVHQDVKTKIKTIVQKIYGGGDVVYEGKANAALRTIAKNGWQDLPVCMAKTQYSLTDNPKTLGAPEGFTIHVRDIIPKLGAGFLVVMTGTVLTMPGLPKAPAALNMDVTDDGKISGLF

SEQ ID NO: 7249 - protein, 134 aa, Lactobacillus casei
LADYRTHYQPAWIDFSMFWSAIVIGLSLAIIIQLESTKPSWLAIAIAAITILTAIGQILLLRLIATEKGIRLTSLFKSNTINLSWSEIEGFTSGHLTVMLKTKQYGRDSFLMFGKKRKQKIVALIEKGLETSTK

SEQ ID NO: 7250 - protein, 132 aa, Lactobacillus casei
MLKLYTDGATKGNPGPTGIGILVSGLPQQIQRHAALPPMTNHEAEFAAAIAGFELLIDAKLTTAPVAFYSDSKLVVQAIEKRYARHYPALTAELLALIDRFPLVLPNWLPDRQNRGAHTLAQQGLREAETKS

SEQ ID NO: 7251 - protein, 200 aa, Lactobacillus casei
VNQDLLNLLKQRRSIYALGKDVKQKDDDIIEQVESVIQATPTAFNSQTTRAVFLFGGQHDKLWDIVVKRLKSEVPTEEAYEATKKKVAGFKAAYATIMYFTDTDIVKQLEHDFPLYADNFATWAEQAQGSAQLNTWVALANNGIGANLQHYNPIIDELVSDAFDIPQNWQLRAQMPFGSIEAPAQDKDYMDRTSQFKVFM

SEQ ID NO: 7252 - protein, 489 aa, Lactobacillus casei
MSLITWLIIIILVLNTTGAIFTVLREVRDISTTWAWLLVLIFLPIIGFGFYLFAGRGLSTKKLRRIQREYESGVKAFVSLQKHENARNKLLPPTDYTPAAKALTAFFLNTAQAPVLAHNQVQLYTDGEKKFAALFRDIESAKHYIYVEYYTIYNDELGNQFQQLLIKKAKQGVTVKVLYDAWGSMGASAKWWRRLTDVGGQAESYFSSKHPITDFRLNYRDHRKIVVIDDHVGYIGGFNFGDQYVSRKPKFGYWRDTHLRIIGNTIYALKIRFTMDWNATVGEQDEIAYNVEQDSTENRSNESMTAGSTPIQIVASGPDRPTQQIKLGYTKLITSATKSVWIQSPYLVPDDTVIDALVSAAMSGIDVRIMIPDMPDHPFIFRATQYYATYLARAGVKIYHYQHGFMHAKTVVVDDAIASVGSANFDIRSFKLNFEVNAFIYDRKVAGALAEIFEADMKQSYLLTPAIIASQSRWLRFKQDFSRLLSPIL

SEQ ID NO: 7253 - protein, 108 aa, Lactobacillus casei
MKRDKKADEAAVVDMNDTLMDYAHKRQPHVEDLAEELANRAKDDLNAIDAYLKDGGEARKEYQAIAEGYLRDKYNLEGDELTTARDTLVQAAIHYLLGHTKALDDWQR

SEQ ID NO: 7254 - protein, 483 aa, Lactobacillus casei
MAFEELFLDREERERLALYGDLRDAPNRQMNIATAAMARGESYRQLRRQMAKVAEDLHAIDPSAPPLLRRGDGNMTAPPSISRVRYRIFLFRRSLPGKLLVKTLMQPDLTLPMLLEETGFSRAAFFRRISALRGYLRQKEVTINLTPLALAGAEPRIRQVYRQLLWQLVDTQDPLFATMMPQSRQLVQSLQAAGLIRPDFSVKQLQFSANINLYRLQANHSIGNTLNFAALQPRPVLPDELPDVLAHLPREVAEAEILYLYLGQWRIPRFHTEQQFDAAGFVGYHVAHNTSAWQTVEKIRTEFSRHLIGISPAVSKDLALAGNLLKILISERIFPDGAYIDLAKTASPMRPLFPRLGKAIEAFFAREEPDEKVRSEIIDGFYQLLWPFMTESAVANKLKVALDPLMPQPLYETVRLNLVHPAYIRLVTIDQHPDFVISAHTLAASEESSVPDTPVFYLDSERFESWSALYQVLFRRSRQQFHL

SEQ ID NO: 7255 - protein, 76 aa, Lactobacillus casei
MRNITLFTRNGCPQCRMTKRYLDTHKIPFTEHNINEEPEYIDYLKKKGFQQVPVLEADGLDSFSGFRPDALKQLAV

SEQ ID NO: 7256 - protein, 723 aa, Lactobacillus casei
MSLKTISPDEVTYYALNNEINIPVNDQIPLNKDKEALQAFLTENVAPNTMKFSSLQERLKYLVDHHYYEADFLKKYQPVFLEKLDQFLTAQHFQFKSFMAAYKYYAQYALKTDDGTQYLEDYKDRVFANALFFADGNEQLAVDLADEMIHQRYQPATPSFLNAGRQRRGELVSCFLLQITDDMNSIGRAINSALELSRIGGGVGLTLSNLREAGAPIKGIDGAASGVLPVMKLLEDSFSYSNQLGQRQGAGVVYLNVFHPDIISFLGAKKENADEKYRVKTLSLGVIVPDKYYELIKDNADMYLFSPYSVERAYGKPFSYVDITKEYDNMVANPDIKKYKIKARDLENEISKLQQESGYPYIINIDTANNASPIDGKIIMSNLCSEIMQVQVPSKLNNKQEYEVLGTDVSCNLGSTNIPNLMHSRDFGHSVEAMVRALTYVTDHSNIDVVPSVQHGNHMAHSIGLGAMGLHTYFAKNHMYYGSPESLDFTNIYFLLLNYYTLKASNKIAKERGESFHNFENSKYADGSYFDKYIQQSWAPKYDKVRDLFKDVHIPTQADWEALKESVMKDGLYHQNRMAVAPNGSISYINDTSASLQPIVNRIEDRQEKKIGTIYYPAPGLSNDTMPYYQSAYDIDMRKVIDVYAAAQQHVDQGMAMTLFMRSTIPAGLYPWKDGRTDKMTTRDLNILRNYAHHKGLKSIYYIRTYTDDQEEIGSNACESCSI

SEQ ID NO: 7257 - protein, 326 aa, Lactobacillus casei
MAKQYIAINWNAIEDEVDKATWEKLTEQFWLDTRIPLSNDLDDWRSLSPDEQWVVGHVFGGLTLLDTLQSQDGMASLRQNIRTQQETAVLNNIQFMESVHAKSYSSIFSTLNTPAEIDEIFDWTNHNEHLQYKANKINDIYHNGSALQKKIASVFLETFLFYSGFFTPLYYLGNNKLTNVAEIIKLIIRDESVHGTYIGYKFQLGFNELPEAEQQKLQDWMYDLLYDLYENEEKYTNDLYAKTKWTDEVLTFLRYNANKALMNLGQETAFADTADDVNPIVMNGISTSTANHDFFSQVGNGYRLGQVEAMQDDDYTFSTEDEGHDK

SEQ ID NO: 7258 - protein, 296 aa, Lactobacillus casei
MELQTLRNFIEIADHGSITAAARTLGISQPGLSRQLKDLEKELGVKLLIRGNRRVTLTEDGTYLLNRARELTAIAERTKNNLQGKHTLGGDLYIGASETSGKRLMLQVAQSLRLQYPSLHVHVTYGSDESLIANLEAGMYDFILRPGKEQTQYESLPLPIRDAWGVLMTTDDPLTDNLLITPNDLNDSELILPRATHTRNAFEHWLGQGLDPAYIVGTYDLTADALGMTAVGLGRALCLEYLATQTSNTSLTFRPLAPALADPIALVWKRDRELSRIAQRFLSLVHETISQQKAES

SEQ ID NO: 7259 - protein, 634 aa, Lactobacillus casei
MTSKVRYQDDLYRAVNGAWMDQAVIPDDKSSTGGFQDLADEVEEKMMADFAAVADGSKEAPDKYFAQAVTLYQQAKDFKTRDAAGFAPALPTLHQVAAIKDLADYNQRAAELLQQQLIDPPFNVFVDADMKDTSKNVINLMGPKTILPDTSYYAKDNQNGAQLLAIFKDMMSKLLAYTDLDEAAQKATLAGALAFDAEIAKHVKSSEEWADYPKAYNPMPTTTVVEKLKPFDFENFLKAIFKTVPDTIVVADPRFLDEFGQLFNEANFANYRDWLYVLSLDSVAGFLSEPLRQLGGTYNRALSGAPKSPDQVKHAYRVANAYFSEPIGIYYGRTYFGEKAKADVTQLVEKMIATYKQRLANSDWLSQPTKDKAILKLDKMVLKMGYPDKPEAIYDLLHVDPEKSLLENLKAMQIVQQQYNYDKLGKPVDRSVWNMPGHLVNASYDPSKNDITFPAAILQAPFYSLKQTASENLGGIGAVIAHEISHGFDNNGAQFDEFGNMVNWWQKADYAHFNELTKAMIDEFDGLETEAGKVNGKLVVSENIADAGGLAAALDTAKREPDADLRAFFINWARIWRSKSRLERAKMLLAVDVHAPHELRANIQPRNLDDWYTTFDVQPGDGMYLPPEKRVQIW

SEQ ID NO: 7260 - protein, 424 aa, Lactobacillus casei
LIKTHKIKLYPNATMRRELERLFNYRRFCWNQALETWNVMYDASLLMADKTLRPNERKVRDELVWNKADWQYEQSARVLQLAVNDLSKAWKNYFNPKMPDHGKPNWKSKKRSRKTFKTDRAQLLNGKLRLDKPRGAGAWYDIKLAEQPHWQGELKQVCVVQAADGYYASFSIEVQTSVEKRPVLTVTGVDANIGKFDYRTSTGYAIQPTLPDRLPILYARIAHYQRQLARKRKVNPKRFNSAAYRTTRTKLKRQYQRVERIQTDLLQKFTTMLVTDYDLIGIEDLDNQHMRMNKRLAKNLHRSLFGKFKVIMQYKADWYGNTLVLADQFYPSTQRCSRCGHVKTADERVTLSGNLKHRTGHDDYHCYQCGVKLRRDENAVENLIAYAKSKVYGVGYTLKVQEAVTVGLIYFSAGIPLLTGLNEM

SEQ ID NO: 7261 - protein, 337 aa, Lactobacillus casei
MYYVIMKSHDIRENLATEQYLMNAKQFDEPLLLFYYEKPSVIVGRNQNTLEELNQKYVEEHNIVVTRRLSGGGAVYHDLGNLCFSFVVDSDSEEFGDFKSFTQPIVDAIHTLGATSAEVSGRNDMLVDGKKFSGSAMYTRNGKTFSHGTLMLDVDMSVIPKVLNVPEDKIKSKGIKSVKSRVTNLRPYLDKKYQDMTLPEFRDILLTRLFGVDDVAEIKDKEYHVTDADQVEIKKIYDDVYNNWDWVYGHSPEFTTKKRKHFDYGTIDARFDIKDGKIANVKFYGDFFGPQDVADVAAALKDKPYTSQAVKETLDGINTNDYFTNIPKDDVINLLVP

SEQ ID NO: 7262 - protein, 75 aa, Lactobacillus casei
MAQRPEEITNLLQDALHSQHEVAIDTIDRRCLKGRVVDIKAAKVKPYNERGVITVATGRGAKRIQAYAISQIKYN

SEQ ID NO: 7263 - protein, 311 aa, Lactobacillus casei
VKILNSFTLEPAQRQALEKAGHTVIEEDQLDATTAQQIDVIYGWHAASATVNYDHLQFVQAMSAGVDYLPLADFAKHHVLLANTSGIHAEPIAEYVLGALFTISRGILPAIRAGRQMWTLRQERPPMTLLKGLTVVIFGTGHIGSTIASKLQALGLHTIGVSAHGRPAAGFEDVVTDAETKRVIRTADIVINALPLTPATRYFYNEEFFAALDRQPIFVNIGRGASVETAALVQALQSQQLRAAVLDVVDPEPLPQTSPLWDMDQVLLTPHISGTVPHLRDQVFKIFNENLQALVLSGQLASHQVDLSRGY

SEQ ID NO: 7264 - protein, 383 aa, Lactobacillus casei
MTYQLVATMAAGLEAVTTKELKALGIETRTENGKVYFQGDDQTIALTNVWLRSADRIKIVVGQFKARTFDELFEGVKALPWDQYLPLDAAFPVEGRAVRSQLHSEPDAQAITKKAIVEKMSAVYHRTTRLPETGAKYPLEVSILKDVATLTLDTTGPSLFKRGYRIAKGEAPLKENFAAALVLLTNWHPDMPFVDPTTGSGTIAIEAALIGHHLAPGLQRHFAFENFAFFDQDVLKTTKDQAMDQADFDRELDIQASDINGEMIDMAKLNAQQAGLLHSIHFKQLAVKDFTTTKENGVIVANPPYGQRLSDQAAVRQLYAEMGQAFAPLTTWSKYILTSDMGFEKAYGSKATKRRKLYNGTIRTDLFQYWGKPNWHHHDRKEG

SEQ ID NO: 7265 - protein, 93 aa, Lactobacillus casei
MVKTAITPKATYTPVSKRAGSRSQKNSPSLPELCLHVDPYKPCFVPEPVQAQVPSVIIYLSVAAVLPSLHFAWQNAPTKSLGYSLAGFTRSTV

SEQ ID NO: 7266 - protein, 37 aa, Lactobacillus casei
MPAQAAMLVVFVLSPISLGTVSTVTATNRAKVSAMRQ

SEQ ID NO: 7267 - protein, 132 aa, Lactobacillus casei
MDSNKETKFSIQYGPKDILDKKFKNKVRGYDPDEVDEFLDGIIRDYEAFTNEIDRLKEENAKLFSRVDELTKQLSVSKNVSAQTPQTNAAATNYDILKRLSNLERHVFGSKLSDSGSADTHDDNSHSDVDQY

SEQ ID NO: 7268 - protein, 191 aa, Lactobacillus casei
MAGKRLWITGYRAYELNVFGNQDPKLKVLKTSLKNTLLQYLDEGLNWLITGGQLGVEQWAIEVALTLKPLYPDFKIAMMLPFTDFGSKWNEANQGQLAALRQQVDFSDAVSQAPYQRPAQLQGYTRFMTAHTDAAVIVYDPEFPGKPQWDYRAAEDMAKRRDYPVTLITMDDLEDTAQEMAEAENEHFQND

SEQ ID NO: 7269 - protein, 208 aa, Lactobacillus casei
MTIRYPNGNPYKDGTQLSPDPVSRPTIYGGRGMTLEEELNLSNQYYRSVDKAVVYKKPTPVQIVKVDYPKRSQAVIREAYFKTPSTTDYNGVYRGYYLDFEAKETKNKTSFPLKNFHQHQIDHFRRCLKQNGICFVVIRFATIKRLFVFPASRLIACWDHQSTGGRKSIPLTKIIQHGFELHPQLQPVVPFLDGVDWLIETKVGNLRG

SEQ ID NO: 7270 - protein, 768 aa, Lactobacillus casei
VADNQNMSRMARRREDKLTNGPKPPKKLWRRILKWTLLGLLVLFIAGVGLFSWYAKDAPEVTQAKLESGGSSTIYDRSGNEITTLGLENRDYVKASEIPQRLKDAVVSIEDRRFYDEKLGIDPVRIIGAAFNNLTGTSDGLQGGSTLTQQLIKLSVFSTKSSDQTLRRKAQEAWLAMQVQQKYSKDQILEYYINKVFMNYGQYGMSTGAKFYFNKSLKDLTLAQTAFIAGLPQSPAGYDPYKYPQKATQRRNAVIDAMLRDKKITAADAKKAKATPITDGLQPKQQQTNTTTNDKIVDSYLTQVIAEVKKKTGLNPYTDNLDIYTNIDMSAQRRLYDIVNTDDYVNFPDDSFQTGVTMTDPDNGEVLAQIGGRKTGDVRLAYNRAAQNTRSNGSTMKPLMDYGPAIEYLNYSTYEQMLDEPYQYPGTSISLYDWDKKYQGRISMRTALEQSRNIPAVKTLSAVGMTNAVKFLKGLGIDLPSSEQYLSSAIGASVNTVQEAGAYGAFANGGTYYKPYYVNKVVSADGNTQTFNSQGTRAMKSSTAYMITDMLKGVLTKGTGTAAAISGLHQAGKTGTTDYSDAELKQNPALNATGIAKDAWFTGYTRNRVISVWTGYDKPTSHGISYAEQEISQKIYKALMSYTSQNLDNRDWTKPDTVESYNILKGSNPGTAITGGSGNTTKELYVRGHGPSSRKAVAESSSSSATSESSSSRASDESSSSEVSESVESSVSTPSVTTPSASQASQEESSSNSTPSSASGGGSSSGNQ

SEQ ID NO: 7271 - protein, 154 aa, Lactobacillus casei
LTDKIVPSKRRVHRESWDHYFLELAQQVSERSTCERATVGAVLVQEHRIIATGYNGAISGDPHCDEAGHLMRDGHCIRTIHAEMNAIIQCAANGVSTHGATVYVNFFPCLNCTKALIQAGIKRIVYAHDYRNDPYGEALLKQHHLDVLHLAPQD

SEQ ID NO: 7272 - protein, 217 aa, Lactobacillus casei
MTDVEARQLFNQIMALYPDPEPTLHAANPFEILVAVMLSAQTTDIAVNAVTPALFAAYPTPEAMAAAPVTDIAEKISRLGLYRTKAAHLKALSAILVQSYGGKVPADAADLVKLPGVGKKTATVVLSDAFGIPGVAVDTHVSRIVKGLGLVSPKATPVQIQKRLEALMPKSTWIKLHRSLIRFGREHLRARDPKIPAGSEWSFLAQHYAPLKEAAKH

SEQ ID NO: 7273 - protein, 206 aa, Lactobacillus casei
MTDLRTYTEAGQFSVSNLLFDHYPALGLTQTEFLTYLFLDQWQSEHHQAPDLKALANQMNVAPNAIYTAIETLIQKKAIVLESVPDNQGRMRDYYDLSPLLAKIPNSGQTASTAMTQPNADAQTNVFNQIEIEFGRPLSPIEQETIRDWLTTDHYLPEVILLALREAVLNSAYSLKYMDRILLNWERRHLKTAQQVQADIKRHQEL

SEQ ID NO: 7274 - protein, 432 aa, Lactobacillus casei
MTEKIRIIDAKEHVNEEVKIGAWLTDKRSSGKIAFLQLRDGSAYFQGVVSKADVSDEVFKLAKELRQESSMWITGVIHQDSRSHFGYEIEVRDIELVGDSADYPITPKEHGIEFLLDHRHLWLRSKRQFAIQQIRNEMIRATFEFFNNEGFIKMDPPILTDSAPEGTTELFETDYFDKKAYLSQSGQLYAEAGAMAYGKVFTCGPVFRAEKSKTRRHLTEFWMIEPEMAFCHQEESLKVQERYVAYLVQAVLDNCSYPLHLLGRDPEVLKQYTKLPYPRISYKKAIEMLQDAGMNVKYGDDFGSPEETYLSDQFDQPVFVLNYPKNIKPFYMLTDPDDPQQYVCADMLAPEGYGEIIGGSERETDYDTLKAAIEKAGLDLDEYEWYLDLRKYGSVPHSGFGLGLERAITWICKLDHLREAIPFPRMINRLKP

SEQ ID NO: 7275 - protein, 391 aa, Lactobacillus casei
VHLAKRILNVAPSATLALSNQTKELKAKGADVIDLSIGQPDFPTPKAIDDAAVAAIQAGNASFYTAATGIPELKQAISDRIFAQDGVRYPARQIVATTGAKFALYALFQIYLNPGDEVLIPVPYWVSYEEQIKLASGIPHLVMPAVGHKVSVDDLEAARTDKTRALIINSPQNPSGVVYNRTELTLIGNWALKHHILVVTDDIYRDLIYNGTSYTSMISIDPDIADNTVLISGVSKSYAMTGWRIGYAAGPEKLMQAMATFISHTTSNPAAVSEYAAVAALTGDQSVVEKMRQAFEERLNLFYDLLAEIPGFDMGEKPQGAFYLFPNIKRAAQLSHYGTVDDFISALLNETGVAIVPGRAFGMPDHARISYCKDLNSLREAARRIQEFVRK

SEQ ID NO: 7276 - protein, 163 aa, Lactobacillus casei
MRRHRRFDWLKFSLISGLIILIIAVIGIYAKSISPYQQLRSQAERIATNRADLKTINGFWWYNRDKSYLSVAGRTQKNKSVYVVIQKKTGKVDILNQKSGITRQQAIQQATSDNNPKKILNASLGKRGSEFVWDIGYLSKSGKLNYVTYSFRSGEQLNAIKNL

SEQ ID NO: 7277 - protein, 926 aa, Lactobacillus casei
MNADTTFAVVDLETTGTSVKDGDRMIQFGCALLRHGKIIQTISQMVNPDRSVPQTIQRLTGINPDRLVAAPYFDEVAPVLHDLLTNTVFVAHNVNFDYPFLNAEFERVGLPKLQLEAIDTVELAQVLLPEISSFRLSDLTAYLAIQHDNPHQADSDAISTGKLLLQLTKRFQELPTPTQQALIQHRGGFIRETGDYLNLIATPPNPLKKAYVQVGSLVLRRPVTPTTDFALSGAYPATDLAKKHLLQPRYRFRKAQAKMMDAIFAHTHQPEQPLFVEAGTGLGKTLGYLLPYAYAATPEHKLVIATPTLVLQTQLMQKAIPALNDLLGRTVPSVEVKSPQHYLDLNKFAASLHQEAPTRQTQLLQMKLLVWLTQTTTGDLDELHLTTYRAPLFLQIRHTGDVGTPFTNPFYTLDFYRRLQTATDAAVIVVTNHAFLARHVEQLAGGQPFLVVDEAQHFADNTAAAFAQHMALGHLRRQLRHLWQLSDPDESHSLVAVYQSEPAMQMVLRQLHQLTETAQTTVTTLQQDIYRHFFHGKTTAMSGFVNLSLDPAAVDWLRETQSDKVKLLIKVIGRLTVTAGKLTADFNQRPRFFLKSDGQRFQALAALRMSLADQRNRLQEMLRRLPELINGRAAVASITLSQVKDVASLGLSWDVFQVGAAVQQLLRQFTAPVFVGATLTAARSFDFLTRQLGYGELPETSFLKLRSPFHYRDQAKVLVATDAPNASEVSASAYADYLAQAIELLADNRHQTIVLFNSLAVIEDVYQRLIHRPIADHKELLAQGVTGSAEKIAKRFAVGEQSLLLGAASFFEGIDYPDRLLEMVILTRLPFDAPEAPITKARYAQIKASGGDPFTDDALPRATLRLRQSFGRLIRTETDRGAFVILDPRFITTQYGKKMQKSLPNIKPMTMPLNDMPEYVKMWLRA

SEQ ID NO: 7278 - protein, 1236 aa, Lactobacillus casei
MTKFTSSQQAAIDHHGHDVLVSASAGSGKTTVLVERIIQKILKQHADITRMLIVTFTRAATAEMRTKIQSALKQTLTQKRHELNAEDRRHLANQIAMVNAAKISTLDAFSLQIVQTYYYVIDLDPGFRLLTDETERYMLQERVWNDLREQFYAGDDATAFEQLTANFSGDRDDSGLQDLMFELMRQAAATTDPEAYLRQLAEPYAPEAWEQTFNTQIWPRMKQKLLQITTDLTQAAALADQLPNPIWQRQIEADLAPLQHLLENAAPTYDTVRAVLADHQFETWSSARKGLDDNDKATKKAAKQLRDAAKTTWQKQVAPEFALTGEQIKDLLQTVQPMMQMLTKVALQFLAALTAEKADRHVQNYSDIAHNALRILQQQDPQTGAPIAENYRASFDEVMVDEYQDISPLQEALLAAVSTTDPGDRFMVGDVKQSIYGFRLADPQLFIHKYQSFADQPSDPAAPERIILAENFRSTKNVLAFTNLIFSQIMDPEVGDLSYDDRAALKYGAVDYGDCHPAVKMLLYSKATSDEDDESTDAPDLPESVDDDEPLDVATGQTQMVIAEIQRLVEDPEAKLWDRANQTYRRIHYRDITLLTRQTTQNSLIQTQFAAAGVPLFVADTKNFFKTTELMVMLALLKIIDNPKQDIPLVAVLRSPIVGLSADQLALIRLAAKQVPYYDAVTAFLAATPSTPLAKQTHATLIQFFQQLKHFRDLARENDLVTLLWAIYQETGFLDYVGGTPGGSQRQANLQALIDRAQTYESGGFKGLFAFIHFITLMQKQDQDLATPAQVDPDQDAVRLMTIHKSKGLEFPVVFVMQTNKHFNRRDQRGAAILTKNGIGVKWVDPETRVEYELPQYQAAKAARQNQTLAEEMRLLYVALTRAQQRLYVVGATMSGQQLTSADKTVARWAKEAESEELVLAPQVRSAATNYLDWIGPALIRHPQVKGLAETTVKPALIGDSTEFAIEIEVNPQVKPAATATKSAPAEAPSLDLNSWFKQQYPFQAATTTAGFQSVSEIKRAFDDPDTMELVSADRFLGPQPPLGDLAAPVFLTQSSGGVSATAVGTATHLLLQLVDLTQPVTHTSLDELRRHLITTGAIPKEVAARIDLSALVRFFATDLGRLLQAKPQQVHREVPFSMLLPADRLFEGLKDDPGEDVLIHGIIDGFVSDAEGVTLFDYKTDHEPNPEVLVARYRGQLNLYAQALTRLQPKPVNHRYLVLLRTGTIVDLVANPIGK

SEQ ID NO: 7279 - protein, 1179 aa, Lactobacillus casei
MGLQFILGDATRDHAQTMAAMIQEQLAADPQNQIFFLVPNHIKFEAEIDLLKRLRQLQQGEADAYAQSRVQVLSFSRLAWFYLKNTPLYQQPRLDQASNTMLVAKILADRQDDLTIYAGEAQHTGFVTQLADQLSELMIGRITAEDLMHTVSALAPGDRHRAKLRDLGIILDQYEAEIGPYATTASLLSGLQQAMRTQDLSHTFIYLNDFNVFSASESALVETMLETAAEVTLGLVLNKPYPLNPPVAPNLFLPAGRLYQRLYQKAKTLHVPIRPDQFAAPRQISRGMQQVANWWEANTDLQPSTAPTSETAEQIHLAIATDPYQELRHVAQHIYRAVRHGARYRDFLILARRLEPYATVIPAIFAEFSIPQFTDLQRPMKDHPLVVLMESLFAIQKHDYQYQDVMRLLHTELLLPEGMSLAEFRDAVDTTDNHLVRTGIAGKQRWTQPAAWRYFQRNPDADDPQMDPEAAKTAQINAIKTLIAQTVPTLLKQWQTAKTGAEAAGDLYRWLDANGVVDQLRAWRQTASDAGDLTRSRAHEQAWTTFTALLDNYVTILGSAKFDREQFHELLAAGFASATYTQIPATLDAVVISETGLVRLAKAKHVFVIGATNTAMPDVPTDDGVLNSEERQLLAAQLPDDRFLPEQGPATTLGDPFINYLGFMAASDELTLSYPVQNAQENSENQASPYFQQMGNALHLTPTAWAPVSLTTPVETVLGSPRAMLSDFVRAAGDAQQQKLPLGQAWQSVLAALKQTDLATLSRRLAGSLTYQNDPGQLDPDLAIQLYGRDMNVSVSRLETYYLNHFEYFLKYGLLLQPRPEFELSPADTGSLFHAVLDRYLTQLREEHVALADVDPAVIAAAIPPLVEDIASQPGYEILGSTHRMLYLTRRLSRLLIQVLVNMRQQQQRSGFRPIRTELQFGRIGDTKGLPGLSWPLPHGGRVNVRGKIDRLDVYREPNARRFIIVDYKSTQHRFNDSDAYYGIALQMLTYIEAMTNVPIDPPFVPAGALYFHLQDPTLPYTPTLEPVIERLKKFKYLGFLVANHGDELSAVDRTISPESGGASEVAPLGFKKDGSFNRSQSNILTPDDLRAYLAHNQALIIDAATQILSGNIDLAPFQYGQSSEVVSRSDYQSIMLFDPATGFDHYHHVPKLKRKDVVNRLTTDPKQTPDSQKETPQS

SEQ ID NO: 7280 - protein, 311 aa, Lactobacillus casei
MEIGTGKSYAKIILIGEHAVVYGEPAIALPVKSIGLSARVAPLPDGRQEVTSAFFTGDLNAGQLTNFAGIAMLIRRLLVFFDASKQGFHLTITSALPSERGMGSSAATAVAVVRAFYDAFQTPLTRTALLNWADISEKALHGNPSGLDAATASAEKPQWFVRGKSLRSIMMPRNGVLLIADTGIAGQTKVAVDLVAQKLKQAPKVYRPLITDIGTAVRQAALALAQDDIITLGQLLNRDQSDLAALGVSSPELDRLINVAIDHGAYGAKLTGSGMGGCMIALAAEDQAPTIIQALKAANAVKVWEYHFETK

SEQ ID NO: 7281 - protein, 334 aa, Lactobacillus casei
MTTYARAHTNIALIKYWGKADKKLMLPATSSISLTLNDFYTDTAVTFDSTLSEDQFVLNDQPQSPVAVSRFLDHVRKLANIKTRARVSSLNHVPTAAGLASSASAFAALALAASRAAGLNLSPIDLSRLARRGSGSATRSIFGGAVIWHRGFDDASSFAEPLAIQPTLPLRMLVVTVSDQKKAVSSRTGMANTAATSPYYQAWVEANETLISPMITALAEDDFATIGALTELSSMRMHAAIMAEEPPFTYFLPETLRAWQLVQEQRRLGIPAFVTMDAGPNVKILTTAPYVDVLMTALRLAFGDRILSTKIGPDAQVITKEQFDDTESAITSQG

SEQ ID NO: 7282 - protein, 344 aa, Lactobacillus casei
MTQSQQSHRKDEHVFLAEKYFKADANAGFDQIRLLHRALPETALADVDLTPPLPFGWRWPIYINAMTGGSPQTGKLNAQLGQLANALDVAIASGSQSVALHDPELSSTFTTLRQHNPDGFIFANIGAGHDVHEAKKAVAMLHANALEVHLNAAQEVVMPEGDRDFLWQDNIQAIAAGVSVPVVAKEVGNGFIREDLQTLQQLGIRYVDLGGRGGTNFAVIENARRPQQDFAYMRDWGQTTAESLLEARGLPLTILATGGVRSPLDVVKAQRLGAHAVGISGLVLHHLIQTGYTATLAYFQEFLHQIRQLYALLGVTNWQALQIAPALLGTELEHYRRARNLPAI

SEQ ID NO: 7283 - protein, 443 aa, Lactobacillus casei
VQLPEAFKEKYTRLLGADAAAFLASFDAAPVSGFRRDPVKPWPLDEATDDPVPWSPWGYYGKIAGNDIDHVAGLVYSQEPSAQFVGTVAAPQAGERVLDLCAAPGGKSTQLASYLGDTGLLVSNEINPARSKVLSGNLERWGSQNILVTNNDPDTLAKAWPQTFDRILVDAPCSGEGMFRKDPDAVQYWHRDYPAECAARQKQILQAAVKMLQPSGELIYSTCTFSPEEDEQIIAWLLTNYDMTLEPIKTYPGMEAGRPEWADGNQELAKAVRLFPHRLRGEGHFVAKLRLAGEKTVHTPAAASVKPLAKPAMDEVRDFFATSLNQPLTGQFYRHGDFLSLLPATMLPFDRVKVVRAGLELGSFRKKRFEPSHSLATALSPNTFQTVIEVDQDGYARYRHGETLPTIATGKRFVLLTFEHKPFAIGKLVNGTIKNFYPKGLRV

SEQ ID NO: 7284 - protein, 318 aa, Lactobacillus casei
VKKLFLIDFLWIGLAILAGLIWSQHDQNEYASQLDHLGMSEMAQEYVTSSSRSVTKAVAELEKTDFSGYQVQFVTKQLVYVYQRGSVASLPVETGQWFSTGDFASSLPVAVVGHDLADKLYTGSNNQRYLSVNGQYIPVMGTVGTRKGSPLNKAVFLNASPSMANEGLTLKHVKIYVDGANQHSKALKTILRASRVHRVHFSDSDAASWWRAYGQTALFCVLLLMGAGILSLLMVTLIGPLQTSGLEINMRARYLRGVLSSCASHVGISLFLGGLFANWWFYFTTRTNIWSFLVILTIATIIFLRYLIRRKDRTSATT

SEQ ID NO: 7285 - protein, 34 aa, Lactobacillus casei
MLDGGLGTVSDSALLVEKRVFWRHNAFAGAGVYV

SEQ ID NO: 7286 - protein, 247 aa, Lactobacillus casei
MTYWTRLNELARKYTPILPLKQQMTAMDAWQTAVANHRLPQRALPWLGLTTPQIEHALALPDARLAELQQLDHLLHNFRRYIAFHYGMWSFVHADFFNVWHRLYGSQRYLEVAAGNGYVSAGLRAQGDTTITTDAHTWVKENVTGQQPLVPVKTATANASLFLYADQVDAVVMAWSPDKDPNDVRFLHIMARSFPDKQLFVIGERQGATNSRLFWQEAQQVPDRRLFALNRALGHFDAIHERVYRLQ

SEQ ID NO: 7287 - protein, 115 aa, Lactobacillus casei
MADHDEATTQDQAYFDKMKQQILDALETVIDPELGIDLINLGLIYGVDLDEDGKCTVEMTLTTMGCPLTDMLDADIKRALTAIDGIESVEIHLVWYPAWGPERLSRYAKMALGIH

SEQ ID NO: 7288 - protein, 62 aa, Lactobacillus casei
MPLVHIDLIEGRSPEQLKALVKDVTAAIVKDTGAPAEHVHIVLNEMAKEHYAVAGVLAADKA

SEQ ID NO: 7289 - protein, 264 aa, Lactobacillus casei
MTSGKQIINRFEDYAPLSLSWERDPSGLQLGNPERTVKTVLVTLDVRPEVVEEAEAVHADMIFSHHPAMFRPVHNLDLRVPQNAMYAQILKDDLLVYSAHTNLDRVQEGMNDWLAEALGLSQVVPFINEGEGANMGRIGLLPEPVRLETFVEQVKAAYNVKGLRVIARDLDRQVQRVAILGGDGGDAFNDAKEAGADVFITGDVYYHTGHDMLAADLPVIDPGHHIEAIMKGKVAALINEWAAVEGWDVKAIPSKLSTDPFTFM

SEQ ID NO: 7290 - protein, 236 aa, Lactobacillus casei
MDHIHLSKRLQTISTFIEPGERVADIGTDHAFLPIELVQRGIIQFAVASDIGAGPVAIAKQNVAAAGLTEQIDVRQADGLAGIKPVDAISTIVIAGMGGQLITNILDAGSTRMDGTETLVLAPNRHQYDIRLWLDKHGYGIISEQIVEDEGHIYEIMAAGKTKPDVPYSEADLRFGPILRRQKNPVFMKKMHREAEKTEAVLEGLADARMVPLAKIREQEHILALIKEELNAHDKR

SEQ ID NO: 7291 - protein, 416 aa, Lactobacillus casei
MAEKKTATEVSKTTKKTTAASAKKTATDVKATAKKTATKKTTAKKTTASKTHTTTKAYDSAVKAVIKDYKKKKQITEDDLTAKLIKPFELKSNAIDDLMQKIEDNGIAIVDENGEPATISLKKQKKVSKKEMSDMSAPSGVKINDPVRMYLKEIGRVSLLTADEEVALALKIEQGDQEAKQRLAEANLRLVVSIAKRYVGRGMQFLDLIQEGNMGLMKAVEKFDYRKGFKFSTYATWWIRQAITRAIADQARTIRIPVHMVETINKLIRIQRQLLQDLGREPTPEEIGAEMDMPTEKVREILKIAQEPVSLETPIGEEDDSHLGDFIEDQDATSPEDHASYELLKEQLESVLDTLTDREENVLRLRFGLDDGRTRTLEEVGKVFGVTRERIRQIEAKALRKLRHPSRSKQLKDFLE

SEQ ID NO: 7292 - protein, 589 aa, Lactobacillus casei
MIPEATVDQVLKAVNIADYIGQFVQLRKTGQNLFGLCPFHEEHTPSFSVNESKQIFHCFSCGRGGNVFKFVMDYDNVTFPEAVKKVADFAGIPLNVQIGHAAPVDPEIAKQQHILQDTADLFHHILVNTEKGEAALAYLHKRGLTDETIEEFQLGYAPEERNLLVAFLNNRKIDYQDQRASGLFVEDQAGKLFDRFNDRVMFPLTDGNGKVVGFSGRILQNDKSQAKYLNSPETKLFNKRDVLFNLHRAKAEIGRDGGPILFEGYMDVIAAYQAGVKNGIASMGTSLTTEQVDIISHLSKRLTVCYDGDEPGQRAIERAVTMLADHPRLQTDVVVLPDGMDPDEYIRARGAEAFQAQVKSVLTPTAFMLQFLARGVDMHNDQAKLTYLNAALKIIGKISDPVARAVYVKQLAETTDVPIAALNQSLPQPQQSQPPVARPAVTDQPARPLDRYTAAQRQLLYYVWHDDLVMQRLKNAAFVFPTDYFQTLFTGWLNFLHEQPDGDLAGFLDRVDPELSGVATDVAMQSLPEATEATIDELIQTITSASTVTRLQAIKQAIVEAQRLGDKQKQGELTVQYVNLMKLLKQQQG

SEQ ID NO: 7293 - protein, 689 aa, Lactobacillus casei
MTHDYLIEIGLEDMPAHVVTPSLNQFHDKTVAFLKANHLEHGRIDRYATPRRLALLVHDLAAKQADIEEDVKGPAKKIAQDADGNWTKAAIGFSRGQGMTPDDIVFKTVKGVDYVYLHKAIKGKSAAEILPGMLDVIKSLTFPTRMKWGAYDFEYIRPIHWLVSLLDGEVVPMKLLDVEAGRVTQGHRFLGKPVSLPNPDAYVSALKDQFVIVEPAARKQLIRDQIKQIATDHQWQIDLDADLLEEVNNLVEWPTAFAGTFDKKYLAIPEAVLITSMKDNQRYFYARDANGKMVNAFIGVRNGNRDHLANVIAGNEKVLTARLEDAAFFYAEDQKRSIAEDVERLKAVSFHDKISSMYDKMARTKVIADLLADQFGLTATDKADLDRAASIYKFDLVTSMVGEFPELQGIMGEHYAQLAGEKPAVAQAIAEHYEPIAADGALPQSLVGTVLAIADKLDSLMSFFAVDLIPSGSNDPYALRRQAYGIVRMIAAHDWPFALAKLQPAIAQALAAAGKTNGLDFAAHQQALNDFIIDRAKQLLQAEKIRHDIVDAVTVRSDADIAGILDAAKLLTAHAADDDFKAVMEALGRVLRITGNKTVDTPVDPDKFENETEGQLHEAVTTTAKTFDAEPTEADYQALKALVDPINAYFDATMVMADDAAVRANRLATLQQLAQLIRQFGDVSQVIVK

SEQ ID NO: 7294 - protein, 298 aa, Lactobacillus casei
MTTKMDIQTMIQTLQKFWGDKGCMLMQAYDVEKGAGTMSPYTFLRAIGPEPWNAAYVEPSRRPADGRYGENPNRLFQHHQFQVVMKPSPENIQDYYLDSLAALGIDPLEHDIRFVEDNWENPSMGCAGVGWEVWLDGMEVSQFTYFQVVGGLEVSPVTSEITYGVERLASYIQDVNSVFDLEWGDGVLYGDIFKEPEYEHSKYAFEVSDQKMLLEFFDAYEKEAWRLMDLGLVHPAYDYILKCSHTFNLLDARGAVSVTERAGYMSRIRKMAHKVARAFVAERKKLGFPLLQHKTEVQ

SEQ ID NO: 7295 - protein, 103 aa, Lactobacillus casei
MAETLPRAVKVWMGANILQIEFDNGQRRFMRTHFIDNYVSSWSPSKGKGKRVNFFVAPTWEWLGANARIESDGKVTLFEKDTYTPEELWHNSKSSIDQLSGIN

SEQ ID NO: 7296 - protein, 271 aa, Lactobacillus casei
MVKQAQTFEGLVMSRQNYRESDMLVKILTDQFGKKMFLLNRARKPGFTLAAGILPFTHADYIGEIRESGLSYLSAIKNATQYRQISTDITLNAYASYIFGLLDLAYPDGQPVGFWFNQIKQALHLIDTGLDPQIIANVIEVQMLKAYGVEPNWRGCVIDGRTDLPLDFSESYGGLLCQRHWDKDPHRLHASARAIFYLRRFSTLNLDQVKRIDVKPDTKAELKRILDVIYTDMVGVTPKAKRFIDQMNHWQDRLPDAHQPNDSQSDNEHRE

SEQ ID NO: 7297 - protein, 300 aa, Lactobacillus casei
VSEHHSGFMAIIGRPNVGKSTFMNRILGEKIAIMSPKAQTTRNKINGIYTTPDAQIVFVDTPGIHKPKNELDDYMDKAALSTLNQVDAILFMVAADEQKGAGDAYIMRQLAEVKKPVYLILNKIDLVKPDDLLPLIESYQHDYDFAQVFPISATMGNNVDDLLTSLTAALPVGPQYYPEDQLTDHPEYFVVGELIREKVLELTRDEVPHATAVQVERMKDREGGKLQIEAYIIVERDSQKGIIIGRGGQMLKQIGIRARRDIENLLGDKVNLKLWVRVQKNWRDNNAYLKSLGYNTKDLR

SEQ ID NO: 7298 - protein, 130 aa, Lactobacillus casei
MLSVLRTAALAARENAYVPYSHFAVGAAVRVGDRIFSGANIENASYGLSNCAERSAIFAAVSAGYTKLDELLVIADTEGPVSPCGACRQVISEFFPADAVITLANVRGDSQQTTPQALLPGAFSKGDLNP

SEQ ID NO: 7299 - protein, 132 aa, Lactobacillus casei
MALPDKQIGKNKHFIQSARHALDGLRVFFVDENNFKREFTSAALVIIAGIWLKVPPFSWFVLILAILLVFLGELLNTIVENLVDFIIGEHYDLRAKKIKDMSAGAVLLVSLIAVVAGVYVFGPPLLDLLRSW

SEQ ID NO: 7300 - protein, 152 aa, Lactobacillus casei
MDLELYDDDHLLDAQHHDLIQKLVAFCGQQLKLPTDTEMSITIVGDDDIQKINRDYRDTDRATDVISFAIEDGEDDLPLLPGMAKNIGDLFIDPLTVRRHAKEYGHSFERELGYTVVHGFLHLNGYDHIKPEDEAVMIPLQKKILAAYGLTR

SEQ ID NO: 7301 - protein, 328 aa, Lactobacillus casei
LAQETSEKIFRLSNPDMAINLVGINDANLTLIEEGLNVRISPFGDELRISGEPETVSLTLQLLEATSKLLSQGIKLSPQDIASAVAMAKRGTLEYFADMYSETLLRDAKGQPIRVKNFGQRQYVDAIKHNDITFGIGPAGTGKTFLAVVMAVAAMKAGQVERIILTRPAVEAGESLGFLPGDLKEKVDPYLRPVYDALYAVLGKEHTDRLMDRGVIEIAPLAYMRGRTLDNAFAILDEAQNTTQAQMKMFLTRLGFGSKMIVNGDITQIDLPNNAKSGLLQAEQLLKGISHIAFTQFSSQDVVRHPVVAKIIEAYGKHDLQLQKRTKE

SEQ ID NO: 7302 - protein, 147 aa, Lactobacillus casei
VALMDELNAQMKQSMLAKDKVTLSVVRMLKTALVNEKIKVGHELSEDEEKSVLATELKQRKESVSEFKKGGRDDLVQETEAEIKVVERFLPAQLSKDQVADIVDATIKEVGATGKQDFGKVMKTLMPKVKGQADGGLVSSVVKEKLS

SEQ ID NO: 7303 - protein, 58 aa, Lactobacillus casei
MAKTVVKKNESLDDALRRFKRTVSKSGTLAEYRKREFYEKPSVRRKLKSEAARKRKKY

SEQ ID NO: 7304 - protein, 276 aa, Lactobacillus casei
MTQELNLYIMSDSVGETGLRLAQAVAAQFPEFEAHYVRFPFIHTKEKIYSSLDEAKKENALAIMTFVTDGFAQLATHYAKDQGVIAIDVMSPIISGIKSITHEEPNHVPGAVHDLNERYFDRISAMEFAVLYDDGKDPKGFLEADIVLLGVSRTSKTPLSLFLANRNLKVANLPLVPNAHIPEEIWQVDPKKIVGLTTDASVLMEFRRQRMIQYGLNPDTAYSARDQVNQELKFAEDLYKKIGCMVINTAHRSIEETATLILEHMGLDEFENTETH

SEQ ID NO: 7305 - protein, 295 aa, Lactobacillus casei
MLIGANVSMKGTKMLLGAVEEAASYDANTLQFYTGAPQNTRRKPTSEMRIPEGLAAMTKDGISHTVIHAPYIVNLGNTKKPENFEFAVQFMREEVARADALHAYAMPFHPGAHVGAGPEAAIKQIVKGLNRIIDPKQHVTIALETMAGKGTEIGRSFEELAAIIDGVTYNEKLRVTFDTCHTNDAGYDVKDDFDGVLNEFDHVIGLDRLSVIHVNDSKNPRGSHKDRHANIGFGTIGFDALNRIAHHPALEKLPKILETPYVGPDKKHQVPPYGEEIKWLKSGHFQPEALRRLMD

SEQ ID NO: 7306 - protein, 306 aa, Lactobacillus casei
MEEIDRLIRRHQNWSRLSAAFFYSICVAVALNMFWEPGGVFASGITGAAQLLATVVRKWFNFDIALPFFSLATTDLFSTGTLLFFLNVPLFILAWKAIGHRFTVFTFLAVIFSTIMIRLLGVLTPLTKDPIVCGIFGAVVNGLGTGFALRNNISTGGIDILGIVLRKRTGRTVGTINIMFNVLIIFLAGFVNDWPHALYSALAIFINGRVMDSLYTRQQRLQVMIVTARPKQVVREIQGSLRRGITIVHDAEGAFHHEEKTILFTIISRAEMYDLEQAMRHSDPYAFVSITDSVKILGHFYEPKTD

SEQ ID NO: 7307 - protein, 147 aa, Lactobacillus casei
MFDKAKRPSKADLKKQLSPEAYAVTQKAATERPFSGQYDDFYQDGIYVDVVSGEPLFSSQDKYDAGCGWPSFTKPITKLAEHRDQSFGMERVEVRSPEADSHLGHVFNDGPIAKGGLRYCINSAALRFIPVADLEKEGYGQYRQLFK

SEQ ID NO: 7308 - protein, 601 aa, Lactobacillus casei
MSKRTCYAGDVTTDYVDQEVTLKGWVQKRRSLGSLIFIDLRDREGIVQLVFSEEFDQDALTVANSVRSEYVIEVHGVVKQRKPQAVNPEMKTGDVEVEVHDITILNKAKTPPFYIEDNVAVTEETKLKYRYLDLRRPEMQKNIFTRAHIMRSVHHYLDDNGFIDVETPTLTASTPEGARDYLVPSRVYPGSFYALPQSPQLFKQLLMGAGFDRYYQIARCFRDEDLRGDRQPEFTQIDLETSFLTAEEIQDITEGLIAQVMHDVKGIDVKLPFERITWQDAMDKYGSDKPDLRFGMQIQDVSDLVKDSDFKVFAGAVQNGGQVRAIVLPGGADKYSRKMIDAQQDYIKRFGAKGLAWMKVTADGISGPIAKFFGDGKTLTQAVGAHAGDLVLFVADKAKVVADSLGYLRTHFGHDLGLIDNKQFRFCWVVDWPLFEYDEGIQRWVPAHHPFTMPNEEDVHLLDTDPHAAHAQSYDIVLNGYELGGGSIRIHNRKIQEKMLKALGFTPERAQKSFGFLLTALDYGFPPHGGLAIGLDRFVMLLTGRTNIRDVIAFPKNSKASEPMTSAPSPVADVQLKDLGIEVRPDVDPEKEHEGDENLTE

SEQ ID NO: 7309 - protein, 427 aa, Lactobacillus casei
MNYQRPKGTADILPGQSERWQQVEAVARKIFAQYQYREIRTPIFENVDVFSRSAGDTSDIVTKEMYTFKDKGDRMMALRPEGTAGVVRAYVENKLYGPEYAKPYKVYYMGPMFRYERPQSGRQRQFHQIGVEAFGSDSPVLDAETLALAKQLLEALGAKHLKFVINSLGDPATRKAFHAALVDYLTPFKDELSEDSKVRLEKNPLRILDSKDRHDQEIVANAPSILDYLTPEAQQHFDRVKTLLTGLGIDFDVDATMVRGLDYYNHTIFEVMSDDKVFGGGYTTILAGGRYNGLVEELGGPETPGIGFAMGVERLMLLMQSDQEAAQPDAFIVTIDQGADQEALQMLTALRQQGFTGEMDYMGRKAKGQFKAANKAHAKLVLTIGESERAAGTVQIKNMATGQQQAFPQADVLADFGKIYTQVTEAK

SEQ ID NO: 7310 - protein, 83 aa, Lactobacillus casei
MVKPHDYGIETIDIGGQSGSETRSQSQKSTCKDLKPKWPKPSHLGLRPLTLRFLNAPARALKKCTPRLLEGCGHGTTLCFTLP

SEQ ID NO: 7311 - protein, 440 aa, Lactobacillus casei
MKPIGQLKKWPLIILLAVLFGVGAATTSVMANTQYMTVKADTVNVRLGPGLAYGIMGQVKSGNQLTIIGAKNSWYQVRLAGNRIGWVASWLVDQSEAATTRAKVATVNQPVNVREYASQDAKQLGSLNAGVSVKVVYQEGNWTQIAYNNTAAWITSSSVQLTGQTTNLAQPAQANLTQTQSNPSLKVTTNTTTNLRNAAGINAPVVEKLDKGTELTVIKQQDDWYQVTAPDGKTGFVASWTVSAPNDGQTQKAATKLSEATIVLDPGHGGTDTGAIANDGSDYEKTYTLKTADLVANALRAAGANVIMTRTTDTFVDLAPRPTTANNAHADAFISFHFDSSPSKNSASGFTTYYYSSKKDLALAKSINGALTGLPLENRGVAFGNYEVLRDNKQPAILNEMGYINNDKDFKHIKDPTYQSKIATDIVNGLNAYFKAGNHQ

SEQ ID NO: 7312 - protein, 208 aa, Lactobacillus casei
MLVNAIWDFDGTLYDSYPGMMKALRSLVLDNGGQIEPDALYRLVKKTSIKKFLTDFGGKVGRSVDELEADYHHRARAYLHDIHPYPAALPVLQAIKDQGGNNLLLTHRDHSAWQILANDHADTLFLGGVDSDLNLPRKPAPDAIQYLLDRFQLNPAVTAMIGDRSLDIDAGVNAGVKTIYFNVDGLNAAPQADFKVNTLEEIPPLFRK

SEQ ID NO: 7313 - protein, 148 aa, Lactobacillus casei
MRAVVQRSLAAQVTIEGKTVGAIDHGFVVLLGVGPNDTQADSDYLAEKISKLRVFSDGAGKMNLALADVGGQILSISQFTLYADTRRGNRPSFTNAADPALGEQLYQAFNAKLRQLGVTVATGEFGGNMQVSLTNDGPVTILFDTEAK

SEQ ID NO: 7314 - protein, 741 aa, Lactobacillus casei
MAEEVELTQPDVMKLCKAYMNPEHLAFVEKAYKFAAYVHKDQVRKSGEPYIIHPIQVAGILAELKMDPETVASGYLHDVVEDTNITLGDIEEVFGHDVAVIVDGVTKLSKVTYVAHKDELAENHRKMLLAMAKDLRVIMVKLADRLHNMRTLQHLRPDKQRRIANETLEIYAPLADRLGISTIKWELEDLSLRYLNPQQYYRIAHLMNSKRTEREAYIQEAIEEIKKALADLHIKYEIYGRPKHIYSIYKKMRDKHKQFDELYDLLAIRVITETIKDCYAVLGAIHTKWKPMPGRFKDYIAMPKANLYQSIHTTVIGPMGKPLEVQIRTEEMHHVAEYGVAAHWAYKEGQTSKVQYDKAGKKLDIFREILELQDESSDAADFMESVKGDIFTDRVYVFTPKGDVYELPKGSNPLDFGYLIHTEVGNHTVGAKVNGKIVPLNYVLKNGDIVEMLTASGSAPSRDWIKIVYTSRARNKIKRYFKQADKSENAEKGRDMLEHELQEEGYTPKEFLTKENLSGLMQRLNFQTEDELMSSIGYGEYTPKVIANRLTEKYRHEKAEKDRKAKEAAILSKNQKVTTVSSERHQPQTHSEDGVVIEGVDNLLVHLAKCCMPVPGDAIVGYVTKGRGVTVHRADCPNVQNSKEMSGRLIEVRWENEEDQKQLFNTDLEIYGYNRSGLLSDVLQVLNAQTKALNNINGRVDHDKMADIHVTVGVRNLAHLDKLMDAVKNVPDIYEVKRANG

SEQ ID NO: 7315 - protein, 107 aa, Lactobacillus casei
MSRVMNWVKVPRNTIICWSVFVTLLLPWVFPLLHLSTAIRVGVLFILINMLSAWWIGKMIHRHHLGWWWLLVLPVLFTLMVLWRYKWYGYFFPPIYIVLSLLAMAKD

SEQ ID NO: 7316 - protein, 242 aa, Lactobacillus casei
MQRFFTVHKLHEKQTLTLEPAIAKHAIKVLRHEVGDVIELADPEHHVYHATIQSTDPLTVLIGEDVTQPVELPIAVEIVCGVSKGDKAEWIVQKATELGAAKIGFFNAQWGTARWPAERVAKKLSRLATIAQNAAEQSHRNLVPEVAMYAKLSDVGNSAAVKLVAYEESAKQGEHAALVAALAEKPASLCVVFGPEGGISPAELAGLKANGFTPAGLGPRILRAETAPLYLLSAVSVLTELS

SEQ ID NO: 7317 - protein, 317 aa, Lactobacillus casei
MNNDWTALTVTTSTEAIEAVSNILMEAGAEGIQIKDAADFKKATIDAHGTWFDPTTIPHLASGAQVIGYFDPATSLIEQRDHIAAQVKALKQFGLDPGAATVTLTDVRQADWANVWKQYYHPLRVSRFLTIVPKWEHYTPEQNGEIVLTLDPGMAFGTGTHPTTQLMLGLLESVVRGGETMIDVGTGSGILAIAAERLGVSRILATDVDDVAVKNAQSNIELNPVSHITVKANDLLQGITMSADLIVANILAEVLVPLIPQVQERLKPKGHFLLAGIIADKAALITQTLQANGFTIAQRRETGGWVALDAVIQEEDD

SEQ ID NO: 7318 - protein, 164 aa, Lactobacillus casei
MSQLNMLDAIGEKMDQFDFDGDLSLNWDKDAHVIELEITMTAQGEVGIEVEDQNGATIDDGPVTYQDAILFYDETRLHGEDYADDYLAIFGFNGKKGIDVATVDALFIYLQDLLDDGESDLMDFVDGTSDNDLFSLNFDDAAFEEILAQQPDANNRIFLPYPKY

SEQ ID NO: 7319 - protein, 201 aa, Lactobacillus casei
MIIPWLATRPTLQSAQQLLGMKLSLANCSGLIVETEAYLGVRDEAAHAFGNRHTKRNHSLFLEAGTVYVYQMRQYCLLNIVTQAADVPECILIRALEPIAGLADMAHRRHQTGVGLTNGPGKLCQALAIDRQLDGTVLNDGQLKLTPTAYRPRNIVIGPRIGIPNKEPWTSAPLRFYVSGNPFVSGLPRRDQDRKMKGWQA

SEQ ID NO: 7320 - protein, 82 aa, Lactobacillus casei
MAENLALRALISQQADTLVSELYTDDKVNARLQKWLAKVPDPGVADTYSYLLSESRDFSEELLYRILSKLVEDGALTLPDQK

SEQ ID NO: 7321 - protein, 128 aa, Lactobacillus casei
MKRVIGVVALLAVLVLGFFGYQYWNSTYNGVEAYAVVTEGKKEASKNDDGSPYKVNGKQYYTYEYDFVWITKDGQERKLGFSSPESADPKPLTPGTYVKAKISQKRVIAGPQTVSADSVPAAIKDKLK

SEQ ID NO: 7322 - protein, 67 aa, Lactobacillus casei
MPWLKHKKDDEPEVGIGDHDFSQFVKNARRDPQRFKAVQSVFSRLKRSPNKNNKNHPPVKHSPKDAR

SEQ ID NO: 7323 - protein, 147 aa, Lactobacillus casei
MVSANLYNTVTAKTRDDRHLKISIKKVPALYDLIYGAFALVMLIVAIVTTLPNGFSFTSVGATLMTWADHLWWLTVPGIIFHLLSYFVSQHSRLLTVGNIIGLCAFIAFILIPNYSVFALIGLVVAMLLILRGANRSHRMREESEVS

SEQ ID NO: 7324 - protein, 218 aa, Lactobacillus casei
VKKKPIYKRIWFWLLVVVVMIIAGGMAGGKGNNSSKQTSSSSQTESKTADASKSTPSKAESKEPDVPADYRSALAKATSYATMMNMSKQGVYDQLTSEHGEKFSAQAAQYAIDHVKADWNKNAVKKAKNYADTMHMSKAGILDQLTSEHGEKFTAEEGNYAIQNVKADWNKNALEKAKSYQKDMAMSPDAIRDQLTSEHGEKFTAEEANYAVQHLSDK

SEQ ID NO: 7325 - protein, 264 aa, Lactobacillus casei
LNDQNAKYTVLNPDHDSQVVISLPHSGTWLPDSMKQALLPTAVLANTDWFLPELYRFLPAAGFTTLINHVNRYVADPNRAVTYDLHHDYRSATIYQRNTFDHPLYAKPLTTAQMQQRVRIFYWPYRHRLSRLLNQKKAKFGHAYLIDLHSFAQYPYYPGVKPKTIILGNDHDRTSSKTFRQALTNRLIEQGWTVENNFPFRGGDITRHYGHQQGITAIQIELRYDQYIAHSAFDEEVLTRYQPDIFGQAQRRLAFLTDFLNRLD

SEQ ID NO: 7326 - protein, 105 aa, Lactobacillus casei
MFEANHSRFATFGIISNLPGEIIDSIWMIIDRNLQGVVPLNNLLRFDLQNNQGKLTVHFSEEGADTEMAVDLPFPYDPSFPDTVMAYDDGESQTILLPEEGHRES

SEQ ID NO: 7327 - protein, 166 aa, Lactobacillus casei
MAKHHKTEKTLVEKMLDKAGITYVPYEFPTEEVGDVAQLEVDHLDVPEHQIYKTLVLTGNKTGPVVGVVPLDRHVDYKKLSKVSGNRKVGMVPLKDLVKTTGYEHGANTPIGIHERHKYPIFISQEAENQQQMIVSAGKVGRSVGIDPKVLADFVNAQFADIATQD

SEQ ID NO: 7328 - protein, 175 aa, Lactobacillus casei
MTINFKDYIASVKDFPEPGIIFRDISPLMADGKAYAAATDEIAAYAQDKGVEMIVGPEARGFIVGCPVAYKLGIGFAPARKKGKLPRPTVKASYDLEYGEATLYLHKDAIKPGQRVLVCDDLLATGGTIAATIRLVEQLGGVVVGTAFLIELSDLHGRDKIKDYDMFTLMAYTGA

SEQ ID NO: 7329 - protein, 764 aa, Lactobacillus casei
MTQYQWQLAAQPDPAAVQQLSQTLGVPAFLATLLWQRGIKDKSDYEAFVHPDISRLHDPFALHDMDKAVARILKAIEHNEKITIYGDYDVDGLTSSAIMLETLQSLGAEPDVFIPDRFADGYGPNAEVYAYLQKTGTQLVITVDNGVAGASVIDAAQEAGMDVVVTDHHELPANLPHAVAVVHPRHPDGHYPFGDLSGAGVAFKVATALLGEPPLESVDLAALGTIADLVSLTDENRVIAQLGLKMIQTQPRVGIAAILKEAGVAPETVNETTVGFVIGPRLNALGRMGDANPGVTLLTTFEEDVAADLAQQVGKLNQERQGLVSKIATEALAMAQTPENQAAKTLLLAKKGWHEGVVGIVASKVVEATGKPTLIMNIADDGMTAKGSGRSIEAYHLFNALEPVRDKMVAFGGHHMAVGLTAKTEALPAIHAQMEAAAATMLKTVPKPTLPIAARLEKDDLTLAHYELIRQLAPFGQGNPEPTFSLRPQVIQNVKQIGKENAHLRFQVDNGINVIGFGFGEAAATLVDAQAVKLAVRLDQNTWQGNTSLQLMLKDYEVKQPQVIDWRMPSVDGSQFKSSRTYVFFDAKVKQQFERQFSFGGPTLTAEQVTSPLANAVLVDLPQNRAQLRALMQQIQPPVAIMFYGAPSHLVAIPTRVEFGAVLHFLKAHPGFDKHHIPAIAKAVHLTVHQVILAIQVFFELDFVTIDGAFISPVTAPAKKPLQTAKAYAAREEFLTLAQQLQTMPRAQLEAMLLTEHTDSEVGS

SEQ ID NO: 7330 - protein, 123 aa, Lactobacillus casei
MAKSQDQFNEKAGKKITVSDEAVDKAAKQIEKVGYVTEKDVPEMIDRDYTRALSKKVSAKLHSDNDDDYFYEEPFDYENGRIANIIWDMDKIKTREEAMKTLANELGLTVPKIVMRKVDEQVF

SEQ ID NO: 7331 - protein, 173 aa, Lactobacillus casei
ASCHDMAINPRTEINMADQQVLDDFFAKAKAALDLPAATYEDAYQLGGSELADELAALVKTGQKTATTSGFELYTIEQDPLPIAGVYNIILDRQDRPVALTFTDNVFVTPFTKVDATIAKREGEGSQSLASWRAAHEAFFRHEYQANGIQFDPASSMVVVEEFHTVYPIVQAR

SEQ ID NO: 7332 - protein, 76 aa, Lactobacillus casei
MSLKNRTALAEKKVTGKLEDIPHPTLDATIYILVFGITALGGLVSYGAYQFFKPERKLAHKAKHIVDDHQRKNEGY

SEQ ID NO: 7333 - protein, 612 aa, Lactobacillus casei
MNHEEMLERQKHIRNFSIIAHIDHGKSTLADRILELTDTIAKRDMQAQVLDDMALERERGITIKLNAVELHYKAKNGETYIFHLIDTPGHVDFSYEVSRSLAACEGALLVVDATQGVEAQTLANVYLAIDDDLEIIPVINKVDLPSAQPDVVKEEIEEMIGLDASDAILASGKTGLGVPEILERIVKDIPAPSGDINAPLQALIFDSVYDDYRGVVLDVRVKEGQVKVGDTIQLMSNGKQFQVTEVGVMSPKAVKRDFLMVGDVGYITASIKTIQDTRVGDTVTLADRPAKEPLKGYRKITPMVYSGLFPVDNAKFNDLREALEKLQLNDAALEFEPETSQALGFGFRCGFLGLLHMDVVQERLERDYGLDLIMTAPSVDYQVVLTDGTEKTIDNPADMPDASEIKEIREPYVKASIMVPNDYVGPVMELSQRKRGEFVTMDYLDKYRVNVIYELPLSEIIYDFFDDLKSSTKGYASLDYEIIGYRQSDLVKMDILLNGDPVDALSTIVHKDFAYDRGKAIVARLKTTIPRQQFEIPIQAAIGNKIIARSTVKAYRKNVLAKCYGGDITRKRKLLEKQKAGKKRMKAVGSVEVPQEAFMSILKMNDEESRGK

SEQ ID NO: 7334 - protein, 390 aa, Lactobacillus casei
MADQKDYYETLGVSRDADDDTIRKAFRRLSKKYHPDLNHAPGAEQKFKEINEAYQVLSDPQKRAAYDQYGSADGPQGFGNAGAGGGQAGGFGDFGGQGGFGGGFDDIFSQFFGGAGGGAQANPSAPRQGADLQYRMDLTFEEAIFGKDTKISYDREAVCHTCHGSGAKPGTSPVTCHKCHGTGYIQVQRNTAFGTMMTRQVCDVCGGTGKEIKEKCPTCHGSGHEQERHTIDVKVPAGVEDGQQMRLQQAGEAGTNGGPYGDLYIVFRVAPSKKYQRDGAEIYLTIPLSFAQAALGDEIKVDTVHGPVELKIPAGTQSQTKFRLRGKGAPRLRGNGTGDEIVTVEIQTPKHLNEKQRAALMQFAAASGEDVTPHNGTLFDRVKEAFKGGK

SEQ ID NO: 7335 - protein, 622 aa, Lactobacillus casei
MSKVIGIDLGTTNSAVAVLEGNQPKIITNPEGNRTTPSVVAFKDGEIQVGEVAKRQAITNPDTIVSIKRHMGEANYKVKVGDKEYTPQEISAMILQYIKKFSEDYLGEPVKDAVITVPAYFNDSQRQATKDAGKIAGLNVQRIINEPTASALAYGLDKGDKDEKILVYDLGGGTFDVSILQLGDGVFEVLSTNGDTHLGGDDFDNKIINWLVSEFKKDNNIDLSKDKMAMQRLKDAAEKAKKDLSGVTQTQISLPFISAGPNGPLHLERTLTRAQFDEMTADLVAKTKQPVENALKDAKLTNADIDKVILNGGSTRIPAVQEAVKEWTGKDPDHSINPDEAVALGAAIQGGVISGDVKDVVLLDVTPLSLGIETMGGVFTKLIDRNTTIPTSKSQVFSTAADNQPAVDIHVLQGERPMAADDKTLGRFELTDIPPAPRGVPQIEVKFDIDKNGIVQVSAKDLGTGKSQNITIKSSSGLSDEEIERMKKEAEENAEADEKRKEEVDLKNDVDQLLFQTDKTLKDVDGKVPEEDIKKVKDAQEALKKAQQENNLDDMKQKRDDLNKLVQDMTVKLYENAQKNQQAQGGAASGAATGATQGGTDKKSDDDTINGDYKDVSDDDKK

SEQ ID NO: 7336 - protein, 197 aa, Lactobacillus casei
MAEKKAKQTAADTAKQAKQPAEASGSSLKEDILKESIADLNDQLKSSQHDGEQLKKERDEFEDKYLRAAAEIQNMNHRFEKEQQKLLKYDGQKLAKAILPVVDNLERALATEAKDDSAASLKKGVQMVYDHLERALKENGITAIDGTGEKFDPNTQQAVQTVAADDKHAADTVAQVLQKGYYLKDRVLRPAMVVVAK

SEQ ID NO: 7337 - protein, 348 aa, Lactobacillus casei
MLTKRQVLVLKEIIRLFTESGEPVGSKRLMRELPIHVSSATIRNDMASLEDAGLITKTHSSSGRVPSTQGYRYYLDHLVEPVRVSHQELATIKQAFSQRYNKMDEIVAQSAQILSNLTSYTAISLGPEVTNIKLTGFRLVPLGNHQVMAILVTNNGNIENQVFTVSQNISSDELEKAIRIVNDQLVGLPLIQVAQRLKTDVPSMLMQYLTSPEGFLDIFGNVLKSAASERFYVGGRLNLMDYLGDSDIHELKKIMSLIDADHGDLTELLGGPIRQTPVQVRLGPELKPIDLANLSLITASYDVGDHGTGMIALLGPTQMPYSKMIGLLDVFREELAKRLTDYYANFDQ

SEQ ID NO: 7338 - protein, 381 aa, Lactobacillus casei
MAGAYIHIPFCEHICYYCDFNKVFIEGQPVDDYVAMLLKEMRMVMAEHPDEKIETVYVGGGTPTTLTPKQLATLCQGIRDILHFNSGEFTFEANPNDLLTTDKLQVLHDYGVNRLSIGVQSFNNDVLKRIGRIHRAKDVYVAIANARKVGFDNLSIDLIFRLPDQSRDDFLNSLQKALDLNLPHYSTYSLILERKTIFYNLMRQGKLRLPTQDVEADMYQDAIDLMEAHGRHQYEISNFAKDGYQCQHNLLYWQNDKYFGFGAGAFGYLGRDRYHNYGPIKQYLTPLHTDHLPVLAHHLVPVSEQIEEEMFLGLRTMRGVSEKRFYQRYHLTVDAVYGETVPELESQGLLQRDDGFIRLTNKGKFLGNEVFQQFLLDEPLI

SEQ ID NO: 7339 - protein, 314 aa, Lactobacillus casei
MEVIDIHPPLQASAAPPQPIVLTLGFFDGVHRGHQAVIKAGKQIALAKKLPLAVMTFDIHPAVVYRGVGKTTIQYLSTRDEKIDLMRQLGVNLLYFVHFTPEFAALSPQAFVDQYLVGLKADTVVAGFDYTYGKRAIANMALLPDYAHGRFEVISVPKLAEDGAKISSTRIRDALDQGDIDTANELLGYAYLTTGKVVHGEARGRELGFPTINLATLGQQRLPGIGIYAVTVNVDGTWYLGMASIGRNVTFGSDRDVTLEINLLDFSRMIYGKTVQVRWYHYLRGEVKFANAEGLITQLKKDETAVRQYFARKG

SEQ ID NO: 7340 - protein, 302 aa, Lactobacillus casei
MNGILPLYKPTGMTSADAVYHARKLLHIKKIGHSGTLDPNVDGVLPLAIGAATKAVPQLMASGKIYTGEITLGFATTTEDLDGEVVKRTPMVKPVPVHELDQALTQLTGEITQVPPMFSAVKVNGRRLYEYARAGESVERPKRQVTVKRFERTSEPIFDATQGIQRFRFEAAVSKGTYIRTLAVDVGQSLGVAAVMSQLTRIKSGGFTLAQAVSLEALGQHITEGTLASVIQPIDIAFAELPKVDLTDDQYDDVRHGRFLTLQLDGPRVRLRYDGVLKAIYRFEKHQYRPDIMFLANEKNER

SEQ ID NO: 7341 - protein, 289 aa, Lactobacillus casei
VHQFSITSSCNEQSSFSRNSRFSFPGLNGIIINIEKGRITIKFLGALYGPFFSIHNWQLAFSVSGLVTIFSLILLECMLSVDNAVVLAAQTEQLKAESDRKKALMYGMGGAYLFRFIAIGLGTYLLQFWPIKALGALYLVWMSASYFYAVRHPKSNTDKKAKRAHGLWGTVFQIESLDIVFSVDSILAALAVSNNPVIVLIGGCLGILAMRIVAQVITTFIDRVPELETAAYVLVGLIAIKLGLSLPMINVKTPDWLFSILVVLIFIWAGWRHAVHAKHHRSMYTKPKA

SEQ ID NO: 7342 - protein, 117 aa, Lactobacillus casei; identical to SEQ ID NO: 1747

SEQ ID NO: 7343 - protein, 927 aa, Lactobacillus casei
MGKKRVYEFAKEMHVDNKDVIDIAKNLGIEVKNHMSSIDQDQEAKIKGVLSKSSAAKTPSTSAAAKPTKSAASTSAKDNQHAAAEKPTRHEHKPARSNKTADGKIILSKSTILRPRGTQTAHKSGNHNRGGEQPAAAAKTGNRNTNRSNNNNRSANNNRPNDRNRRDRNRRFDNQRVTGPMPRAGRPTAANGNPRPVAGNGGKFVKPESERQQPKRQQEAKPAVASKRPERSESTRAKQRPQTEQRSQRTEQRPRTEQPAAKTNQRFTKPAAVTPAAKPATVGSQDNRNSRRGGGNNNFGRGNSFGNRNGFNRNSNRRNKKNKRRQQSQPKKEMPQRKERPLPEVLNYEVGMNAQELGKILHREPAELIKKLFMLGVMVNQNQSLDKDTIELLATDYGIDAKEKVHEDISDLDKVFEEENKNQDNLQPRPPVVTIMGHVDHGKTTLLDKLRHTHVTEGEAGGITQHIGAYQVKLRDRLITFLDTPGHAAFTNMRARGADITDIVVLVVAADDGVMPQTIEAIHHAQAAKAPIIVAVNKIDKPGANPEHVMEQLTEYGLIPEDWGGDTIFVKISAKFGKNIDELLEMILLEADVLELKANPDQRAVGTVIEARLDKGKGPVATVLVQQGTLHTGDPIVVGNTFGRVRAMTNDHGRRVKDALPSMPVEITGLNDVPQSADKFVVFADERTARAAGEERAKRAQEEERKNTTHVTLDNLFETMKEGQLKEVDVIIKADVQGSVEALAGSLEKIEVKGVRVNIIHQAVGAINESDVTLAAASNAIIIGFNVRPTAMAKAQAEQDDVDIRLHSVIYKAIEEVESAMKGMLEPTYEEKVIGTVTVRETIPVSKVGTVVGGYVDSGYITRDAGVRLIRDGIVKYEGKLGSLRRFKDDVKQVRQGFELGLTIENYNDIKVGDQIEAFTMEEVPVK

SEQ ID NO: 7344 - protein, 99 aa, Lactobacillus casei
MQKQAVLNLLGLARRASRLTTGDQLVLGAIRSGDAKLVFVASDASANTRKKFSDKSSYYKVPLVTVFSKMDLSQAIGSDRSIIAVADAGFAKKMQELLT

SEQ ID NO: 7345 - protein, 97 aa, Lactobacillus casei
MKKRKIPMRKDLLSNTMMPKKELVRIVKNKENVVAIDPTGKAAGRGAYVALNPDAVKQAKGKKLIDAAFGITIDPAFYDDLFAYVDHQKARQELFGK

SEQ ID NO: 7346 - protein, 403 aa, Lactobacillus casei
MSKEMIQALDALEQEKGVKKEVVIEALEAALVSAYKRNYNQAQNVDVEFDPKQGDIHVYAVKEVTDEVFDSRLEVSLKDALAINKAYEIGDKIKFEVTPKDFGRIAAQTAKQVIMQRVREAERSIVYDEYSQYEDEILQGVVERRDNRFIYVNLGKIEAVLGRQDQMPNEKYEAHDRIKVYVTKVENTSKGPQVFVSRTHPGLVKRLFEQEVPEIFDGTVEIVNIAREPGDRTKIAVRATNDAVDAVGTTVGPRGARVQAVVNELSGENMDVVQWEEDPADYIANALNPAQVIAVQFNDEDNDRSATVIVPDYQLSLAIGKKGQNARLAAKLTGYKIDIKPESEVEFVDDDELSEAEAEAAEASDDQVDNTEAASDEPTEAEQSDDTSEATPVTPNADDQSQA

SEQ ID NO: 7347 - protein, 159 aa, Lactobacillus casei
LSTQSVVETVTALVKPILDDHHFYLTDVEFVKEGGGWYLRVYIDKPGGITLDECVLVSEALSEKLDSMDPDPIPQQYFLEVSSPGAERPLKREMDYEQAVGDYIHVSLFKKLDGKKIFEGTLKDLKPDQLTLTVKDKSRKFDQVIDRKLIASARLAIEF

SEQ ID NO: 7348 - protein, 1444 aa, Lactobacillus casei
LALSQHEMFEKLLDQLDLPADVKNDPALAEGVVQGVTIHEQSQRYDFTLGFPAILPFQIFNPLATQLPLAFKQIAKTNLTIAVAHPVLTDELLAQYWRFVVQNAEIGTGIVRELCEKQVPTLVNGRAVITAENEQVRQYLIHQGLGKLEETYQQVGFTGLRMQADVDEEQAAQSVAAFEAQKAAQTAKMAQAAAEVVKRQAAKQKQESTDGPVQMGRQLKMSDPPQQMVTITQEERSVTVEGYVFDVEVRELRSKRQLLIFKITDYSSSFIAKKFSNGADDEAMFARIQKGQWLRVRGSVQEDNYSRELTINAQDIQTVSHPDPTDDVEGEKRVELHLHTNMSQMDATNSITDFVNRAKEWGHKAIAVTDHAGLQAYPEAHTAADKAGLKMLYGVEINLVDDGTPVAYRANEPRDLADSEYVVFDVETTGLSAVYDKVIELAAVKMKDGQVIDQFEEMIDPGFPLSELTINLTHITDDMVHGSKSEEEVFKLFQQFCDGAIMVGHNVTFDVGFLDNGYERHGLPDIENPVIDTLELSRMLHPERKNHKLDTLAKLYKVSLEHHHRANADAEATGYLLYALEKEAAKLYGMTKLNQLNDRVGAGDAYKAARPSHAVVLAKTQAGLKNLFKLVSLSNVKYFYRVPRVPRSQLQKLREGLLVGSACSNGEVFTAMMQKGEAEAREKAAFYDYLEIQPLPVYQPLLEADLIKGESHLKDILQKIIKIGEDMEKPVVVTGDAHYLDEHDAIYRKILIHSQGGANPLNRHSLPDVHFRSTREMLDDFNWLGAEKAKELVVTNSNLIADWIDDDISPVKTKLYTPDVPGVEDKLKHDVMTTAHELYGDPLPEIVEQRLDKELKSIIGNGFSVIYNIAQRLVLKSNKDGYLVGSRGSVGSSLAATMAGITEVNPLPPHYRCPKCQYSEFFTHGEVGSGFDLPDKVCPKCGAELHKDGHDIPFETFLGFHGDKVPDIDLNFSGDYQPIAHNYIKVMFGEDHSFRAGTIGTVADKTAYGYVKAYERDTGQQLRGAEIDRLAQGDTGVKRTTGQHPAGILIVPADMDIYDFTPIQYPADDQNAAWMTTHFDFHSIHDNILKMDVLGHDDPTMIRMLQDLSGVEPKSIPTDDPGVMALFSGTESLGVTPEQINSKMGTLGIPEFGTRFVRGMLEETKPTTFSELLQISGLSHGTDVWLGNAEELIKQGIVTLKEVIGCRDNIMMDLIHWGMDDSVAFNIMEHVRKGRGIPDDWQKAMRENENVPDWYIDSCLKIKYMFPKAHATAYILMALRIAWFKVHYPLVYYTAYFSVRAEDFDLAAMSHGKEAVKAAMKEITDKGMDASTKEKQLLTVLEIANECLERGFKIKMIDVTKSDSHDFLIQDDHTILAPFRAVPGLGDNVAKQIVAAREEKPFLSKEDLANRGKVSKTLIDYMTTNHVLDDLPDENQLSLFDGLF

SEQ ID NO: 7349 - protein, 576 aa, Lactobacillus casei
MKQSRMFIPTEKEVPSSAEAKSHKMMLRSGFVRQVQAGVYAYLPLAERVLTRIEAIIDDEMTKIDAVKMKMPVLLPAELWEESGRYETYGPNLFKLKNRQDRKMILGPTHEETFTDLVRNELKSYKRMPLVLYQIQDKFRDEDRPRYGVLRGREFIMKDAYSFTSNDQDLDTIYRQMEHAYTNIFDRLGLRYRTIIGDGGAMGGKDSKEFSAIAPIGEDTIVYSDSSDYAANLEMATSMALPKQGVEAQAELKPVDTKDAKTIAEVAALLKVPEQKLIKAVLFMVDGAPVLALVRGDYEVNDTKLKNILGADFLEMATPEQVETVMHAEVGNIGPVNVDKDVRIIADNSLSGLTNLVAGANKAHTHFLNVNFDRDVTPESFADIRFVKEGEVSPDGQGVLKFTRGIEIGHIFKLGTRYSETMGANFLDENGRSQPIIMGSYGIGVSRLLSAIAEQQADDHGLIWPTTIAPFDIHLIPVNLKREEQKTLTASIESMLEEAGYSVLVDDRNERPGVKFADSDLIGVPLRVTVGKKAVDEIVELKLRKTGETIEVKKEELISSIKILMAQLHKQEQAKA

SEQ ID NO: 7350 - protein, 413 aa, Lactobacillus casei
MTTIIAFIVIFCILVVVHEFGHFYFAKRSGILVREFSIGMGPKLWASHKNNTTYTLRLLPLGGYVRMAGWQDDEDDIKPGTMLSLILNDAGKVVRINASDKTTLEGGMPVQVSRVDLVKDLVIEGYPNGDEDALQSWQVDHDATIIEEDGTEVQIAPEDVQFQNAPVWRRLLVNFAGPMNNFILAILTFIIYGLIFGVQILNTNQVGTVLPDYPAAQAGLKSNARVESIDGKKIHSFTDLSTQVSKHAGKSVMFTVKQDGKTQNIAIKPDKKGKIGVMVPVEKSPARAFTYGFTQTWDLAVRTWDVLKSMVTGGFSLNKLAGPVGIYTMTSQSAKGGLAGLLFFMGYLSLGLGISNLLPIPVLDGGKILLNLIEIIRRKPLKPETEGVVTMIGLGLMVLLMLAVTINDIMRYF

SEQ ID NO: 7351 - protein, 262 aa, Lactobacillus casei
MKQRVITAVVALAIFIPILILGGGWIDTAGAVLALIALSEVYIMRKRIILSPDFLIAALGVLVVVLPNSFFRWLPAFLGRIDLIYVAVALLLFLTVTTKNRTTFDDIGVSVLSFFYIGTGFHYLISVRNDAGLDTLMFALLIVWLTDTGAYMIGRKLGRHKLWPAISPNKTIEGSIGGIVLALITAAIYLMFLPQYYTFWPMMGIALCLSVIGQIGDLIESALKRFYGVKDSGKILPGHGGILDRFDSLLLVLPMLHLFGIV

SEQ ID NO: 7352 - protein, 250 aa, Lactobacillus casei
LATAKGSKVKLDLSRIPAHIAIIMDGNGRWAKRRFLPRVAGHKQGMQNVKTITKAASRLGVKVLTLYAFSTENWKRPGSEVNYLMRLPVDFFNDFMPDLIKENVKVEVMGELADLPEPTRQASEKAMADTANNTGMILNFALNYGGRDELVHAAQKLAKQVQEGALKPEEIDDSRFSSALMTGFLGPLADPDLLIRTSGELRISNFLLWQIAYSELVFVDDYWPDFSPAALESAIAAYQARDRRFGGLKK

SEQ ID NO: 7353 - protein, 185 aa, Lactobacillus casei
MANQIIEQAKTNMGKTEESLQRELGNIRAGRANASLLNQITVEYYGAPTPLNQMAAITVPEARVLQISPYDKSALKNIETAINASDLGINPANDGDVIRLVIPQLTGERRKEIAKEVGKFSENAKIAVRNIRREGLDKLKRQEKDGDITEDELHRLEKDMQKVTDEATKRIDDIAAAKEKEITEV

SEQ ID NO: 7354 - protein, 239 aa, Lactobacillus casei
MVKYNRIVLKISGEALAGEAGFGIKPPVIATIAEQIKQVHELGVQIAIVCGGGNIWRGETGAEMGMERAQADYMGMLATVMNALALQDNLESQGVPTRVQTSIEMRQIAEPYIRRKAIRHLEKGRVVIFAGGTGNPYFSTDTTAALRAAEIGADVILMAKNNVDGVYSADPNKDTHAVKYESLTHMDIINKDLKVMDSTASTLSMDNDIDLVVFNLNEPGNIKRVVEGQKIGTTIEGRS

SEQ ID NO: 7355 - protein, 293 aa, Lactobacillus casei
MAQITAAQVKELRDRTQVGMMDAKKALVAADGDMDKAIDVLREKGLAKAAKKSGNIAAEGLAEIAINGNTAAIVEVNSETDFVASNDQFKDYVNKVAAAIAANKPADLDAAKATKMSDGQTIDEGAIALTAVIGEKISLRRFQVVTKTDNEHFGAYLHNGGQIAALTVLDGADDDTAKDVAMHVAAINPEYLDRSKVPADELKHQTDIFTEETKNEGKPEKIVPRIVEGRVNKWLSEISLVDQEFVKDPDQTVAKYVAAKGGTVKGYVRYEVGEGIEKKQENFADEVMDQIKG

SEQ ID NO: 7356 - protein, 262 aa, Lactobacillus casei
MAVLSMKQLLEAGVHFGHQTRRWNPKMKPYIFTERNGIYIIDLQKTVKMIDDAYNFVKEEAQNGGVFLFVGTKKQAQDAIAEEATRAGQYYVNHRWLGGTLTNWNTIQTRIKRLKDIKKMATDGTFDVLPKKEVSLLKKQQEKLEKFLGGIEDMPRIPDVLFIVDPRKEKIAVQEAQKLNIPIVAMVDTNTDPDDIDVIIPSNDDAIRAVRLITSKMADAIIEGNQGEDQGDDQDQQPAADKKADSMEDIVEAVEGDNKSAN

SEQ ID NO: 7357 - protein, 88 aa, Lactobacillus casei
MVSKYYYFYVLLCADGTFYGGFTDDVEARLATHNAGKGAKYTASRRPVRLLYQEAFSEKHEALSAEWHFKHQSRHKKEQFLTAHHVKW

SEQ ID NO: 7358 - protein, 247 aa, Lactobacillus casei
VLEMSLLPGERVDVLASRNIKIIQSAAVFSFSLDAVLLANFAQVKRHSRIVDLAAGNGAVGLFLARETDGQVTMVELQPRLADMARRSVELNHLTNVDVHVGDLAQTTQVVAKDSVDVVTCNPPYFKVSDQSITNPNDHLALARHELTTDFATVAKVSADLLKYQGKAYFVHRPERLAELLATLTAAGLAPKQLQFIHPREDREANMVLIAAIKAGRPDGLRIMPPLIVHEADGSYTPVVRRLLHGE

SEQ ID NO: 7359 - protein, 216 aa, Lactobacillus casei
MFYSFLRYVVAGLLWLINGHVKAQDKQQLPDGPFVLVAPHRSWLDPVFLALASWPHHFSFMAKSELFKNPLLRWLLVKVGAFPVDRAHPGPSAIKVPVRALKQENKALMIFPTGSRYSADMKGGAILIAKLAKAPIVPAVYQGPGTFWSLFKRKPAIVRFGSPVEPPKGRLTDEALATFSDQLQEKFAALDHAINPDYKYIPDKKKYLEEKEHGDV

SEQ ID NO: 7360 - protein, 464 aa, Lactobacillus casei
MNLWKRMTRKPDLAAALKADDLLTRSLTTRDLIALGIGAVIGTGIFILPGTVAATTSGPAITIAFILAAVVCSLAAMCYAEFASALPVAGSAYAYGNIVFGQVFGWIIGWALILEYMLAVAAVSTSFSAYFASLLTGFHIHLPAAIAGPFSPSHGTYVNLIAVLVVWLIGIMLSRGMQSSMAINRLMVLVKLLIILIFVIVGFFYVQPANWHPYLPFGAKGVLAGAAMVFFAYLGFDAVSASAPEVKQPQHTLPRGIIGTLIIATVLYVLVAIVLTGMVPFTKLDVADPVAFALGAVHLRGLGGFISVGALAGMFTMMVTMIYSSSRLIYAIGRDGLLPRWFGHISGHLPENALWTVVAIIAIMGGLVPLNQLVNLVNIGTLIAFAFVSIGIIPLRRHKAITNDGFHVPGYPVTPIVSFLFCLLLMTQLSVETWLMSLAWFAFGLVIYFSYGIRHGHVSEAKIR

SEQ ID NO: 7361 - protein, 260 aa, Lactobacillus casei
LVNKQTATCLVDGQVYAISDGLFLSDLETKLVNIIKNDYPKATKNSFICNSHLLNYRLERMRRQQRQDERAHEKINRKMSQALVKDDFQLTDVYDNMEATNTFGERIADAVAKYAGSWPFIILFSGFMVVWMILNTVGIFGHKFDPFPFILLNLFLSMVAALQAPLIMMSQNRAAEYDRLEAKNDYHVNLKSEEEIRLLHSKLDHIIADDNPNLFESQRLTVEVMGEMVNQLTETRQQLELLKASQDETDKAVHEEKSKK

SEQ ID NO: 7362 - protein, 602 aa, Lactobacillus casei
VASKGYESAWSKSIPVRQQIKIMRRLMGFTRPYKRQFIGAIVAAALLAGMNVLLPKILQIFMDRYLANQSATVKILLLFAVLYAFGTFVKAVFQFFQTFLFNMGAERGLEDARRQLFAKLHTLGMRYFDQTPAGSIVSRVTNDTMTFSDFWNVILAVIVGLFSVISSFTIMFAANPKIALLVAAFLPILLVVVWYYSTYSSKVYRHMREKLSELNTQLNESIEGISIIQQFRQENRISREFEATNQEYLDARKAMIRVNSLLLSSVINLLYSFALIAVLWTFGLISMHSYVEAGLVYAFTTYTANFFNPMVNMMDNLSFLQDGVVAGSRIFRILDSKEYAPAQHPDAHAVIQQGKIEFRHVSFAYDGKHDILHDISFVANPGETVALVGHTGSGKSSIINVMMRFYEFGKGQILIDDVDIRDYPMEELRKKLGLVLQDSFMFYGDISSNIRLFNDQITDQQVQQAAEFVQADRFINKLPDRYSAKVIEGGSEFSSGERQLISFARTVVTNPKILVLDEATANIDTETESVIQEGLRRIRQGRTTIAIAHRLSTIQDANLILVLNAGRIVERGTHESLLAKHGRYYEMYHLQVGDSGAESTNK

SEQ ID NO: 7363 - protein, 585 aa, Lactobacillus casei
VGIFRKLGWYFKQEWRRYLLGVTFLLLVALVNLIPPKVIGDLVDAMSKSRLTGNYLALMLGLLLFSGIAQYLFRYGWRNAIWGGAAKLERTLRTRLFWHFMKMDATFYQKHRTGDLMAHATNDLNAVQNVAGAGILTLFDSFITGGTTIIAMILVVDWRLTIVAILPMPLLAVMARKLGTRLHAAFSESQAAFSRLNDKTQESVSGIKVIKTFGQEAEDTADFNRIVDRTVQINRRVNFIDALFDPTTSLIMGLTYVITIIYGGWQVVHGQISVGQLVSFVTYVSALVWPMFAIGRLFNILERGNASYDRVNELLQERSTILEAKDAITTPAHGNIRYQINKFSYPNDQQVALSRVHFTLLEGNTLGIVGKVGAGKSTIFKLLLREFDNYDGFIEFGGHNIKDYSLDALLDSIGYVPQDNFLFSTTVADNIRFSAFEKGQQDVENAAKESAVHDDIKKFTSGYETLVGEKGVSLSGGQKQRLAIARAVINAPELLILDDALSAVDAKTEEEILTNMKRDRAHKTTIIAAHRLSSVMHADEIIVLENGQVIERGTHAQLLAKHGWYAEMWAKQEMEAAEEGDVRGK

SEQ ID NO: 7364 - protein, 73 aa, Lactobacillus casei
LLITILVGIIALLVGLAGGFFGARAYMKKYFQDNPPVNEDMLRTMMMQMGQKPSAKKLNQMMAQMKQAQRNAK

SEQ ID NO: 7365 - protein, 81 aa, Lactobacillus casei
MAQQPKERLDRINELAKKDRSVGLTPEEKIERQQLREAYLKDFRAGLRDQIEHTQVFDKKGQEITSKKVQKIQREHGWRKD

SEQ ID NO: 7366 - protein, 58 aa, Lactobacillus casei
MNDQLIYVVYYADRLAPIELLKAFSSRRRAAEYVAMLQNAPYPDHEAANYHYHAVQLN

SEQ ID NO: 7367 - protein, 115 aa, Lactobacillus casei
MNPLIQEITKKQLRDDIPDFRAGDNVRVHAKIVEGERERIQLFEGVVIKRRGVGISATYTVRKISNGVGVERTFPLHSPRVEKIEVTRHGQVRRAKLYYLRALRGKAARIREKRR

SEQ ID NO: 7368 - protein, 264 aa, Lactobacillus casei
MQIDVLSLFPNMFEPLRESMIGKALERHLLNFDVVDYRSYSHDKHHHVDDTPYGGGAGMLLKPEPLFEAMDGVNQRHPGPKRVILMDPAGKKFDQQVARELSQESHLVFICGHYEGYDERIRTLVTDEYSLGDYVLTGGELPAMVMIDAIVRLLPGVLGNDESAYTDSFENGLLEYPQYTRPPEYRGMKVPEVLQNGNHQLIARWRLKESLRRTYLRRPDLLKQVELDDAAKKLLREVKTEEATKAAERRLNASTRNAEDSEQN

SEQ ID NO: 7369 - protein, 172 aa, Lactobacillus casei
MPEYYDIGTIVNTHGIRGEVRVLVTTDFPEQRFQVGKTVYVATSPKTALTIQSVRKHKGLTMLTFKGYTDINQVLPFKGKKLQVTDAALQPLEAGSYYYKDIIGLTVIDEHGQTLGQVSEILSPGPNDVWVIPRAGKSEILLPFLKSVVQSIDLEHKEAHVIVPEGLIDDAD

SEQ ID NO: 7370 - protein, 84 aa, Lactobacillus casei
MVDIGSLIKAIVTPLVTKPEAVKVTAHETGEYMAFDLAVAPEDVGRVIGKQGRVAQAIRTIVYSVKSPYNKRVRLNILDAPHTK

SEQ ID NO: 7371 - protein, 91 aa, Lactobacillus casei; identical to SEQ ID NO: 1776

SEQ ID NO: 7372 - protein, 478 aa, Lactobacillus casei
MAFEGLSERLQKAFSGLRRKGKVSESDVREAMREIRLALLEADVNFDVVKTFIKNVRTKAVGTEVLESLTPAQQIIKIVNDELVKTMGEAAVPLNKAPHIPTVIMMAGLQGAGKTTTVGKLAKYLMDNEKARPLLIAADVYRPAAIDQLQTIGKQLNVLVFEMGTDTDPVEIVRQGLATAKENKNDYVLIDTAGRLQIDEKLMNELKNIKALAHPNDILLVVDAMTGQAAVDVAKGFNEQLDITGVVLTKLDGDTRGGAALSIRAVTGKPIKFIGQGEKMDALDVFYPDRMANRILGMGDMLTLIDKAQKNYDEKQAQEVAEKIRENSFDFNDFLDQMDQISKMGPLEDIMKMIPGMANNKALANVKMDPKDIAHMKAIVYSMTPQERENPDLLNPSRRRRIAGGSGRPVVEVNRMIKQFNQSKQMMNQMSKGNMKGLDGLMGGGVSGKLGKMAMNSMVRKQKRNKKKRLKKAKRFHS

SEQ ID NO: 7373 - protein, 114 aa, Lactobacillus casei
MMEIEKNYRMNSLFEFYGPLLTDKQHAYLALYYGDDYSLGEIATEFNVSRQAVYDNIRRTEASLEEYEKKLHLFANYQAQNEAVDALVGYVRTHYPDDKVLSTLLERVADQTAK

SEQ ID NO: 7374 - protein, 63 aa, Lactobacillus casei
MPKTDLKMTAAGFKTTDDLVDATIHLLDENDYHFLAIALAQELVYHRSDQDKVTLIKEYVQLV

SEQ ID NO: 7375 - protein, 104 aa, Lactobacillus casei
MVATFIYWAVFAVLAAWGLWSLVFSCVYLSNHENGNLWFFAIINTIFGLLGWLFAWIMSNTAWQQYWFASKVQPSAWFTYLLIGYLVLVILQVIFGREKKVQTA

SEQ ID NO: 7376 - protein, 331 aa, Lactobacillus casei
MGLFDAIKKAFTGEEPETPEENKYDEGLEKSRSSFGEKLNALFANFRTVDEDFFDDLEEMLIESDVGFETAVRLSDELREEVKLKNAKDPKAVSRVIVEKLVDMYGEAGKGEDNQLHFAEEGPTVFLFVGVNGAGKTTTVGKLAHQLKEEGKRVLLVAADTFRAGAIQQLQEWGRRVDVPVVATKEGGDPAAVVFDGVKRAKEEGYDVVLVDTAGRLQNKVNLMNELNKIKRVIVRELPDAPQEVLLVLDATTGQNALNQAKEFNQTTQITGIVLTKLDGSGKGGIVLAIRNELHVPVKLVGLGEKMDDLQAFDPTKFVTGLFKGLIEVKA

SEQ ID NO: 7377 - protein, 1179 aa, Lactobacillus casei
LIINGFKSFADKTEIDFVSGLTGIVGPNGSGKSNITEAIRWALGEQSAKSLRGERMGDVIFAGTDSRPALNRAAVTMTFDNSDGYLKNQPAEVSVTRRLYRDGTSEFLLNNQDVRLKDIVDLFMDSGLGRESFSFISQGRVEAIFNSKPEERRGIIEEAAGVYKYKQQKTKAERELANNDDNLARINDIIVELKHQVEPLREQASLAKDYQQQTADYKKIHQTLLALEIEQLAAEQEKTQGEAKVTKATIAALTAKVKDLENQSEQLSAVDHQHEERLNQLNDQVLSRSMKLENLSGEANLSSERSANAATTLADLKDRLTHAQQALTEANQRLADLTKQLDASQKKQQNLKEQLAQQKQASQDPAALNRQLESVQNHYIDLLKAQADNKNAQAALQKDQQLAASQNAAHDRRIYELSKQAQDQEAKVNTLLSQQQKLQAKAETQQTAVEEAKTKLNQLQQNRSAQQQTYQDEMATYQRARARYETLSELNEDYAGFYNGVRVVLKHKATLPGVIGAVAELLEVPTAYQQAFDLALGSNLQAIVTRDEAAAQRAISLLKQQRAGRATFLPAAVMRPRELPSAVLQLVKGADGFLGTGLQLAQYPADLKSVMANLLGSVLIVDTLPHAITIANTTHHRYRIVTTAGDILNPGGSLTGGQVKQGRQASPLARNQEARHLKTQLQKLVEDLKKKQTALTELTKQENVAQAAWQDAQAQSQALAADLTAITSQHTAQAETLRQAQRQLAAAQQANTAQADLSTKMTELRQAGKKIARDIEEAQAEIEQLKTAATAAADSRSKQAAAENALKTKLAVVTNDLQTLHDQHQQWQTQARDANEQITELQQRIEHITATAKETAAEKASRTATIAKLQEELKQLKAEQTKVTQTKAANRGKLSEISARITTTYEQQHQAMATSEQQAVALNRVKLGLDARLNTLAEDYQLTYEAAKAAVAPDHAPIPELKSKLKLLKRGIDELGPVNLNAIEQFKEVNQRYEFLTKQQDDLLAAKQQLEETMHELDETVKTRFKNMFDQTNSAFEAIFPQMFGGGHAHLSLTDPDDLLATGIEISAQPPGKKLTRLSLLSGGERALTAIVLLFAILKVRPVPFSILDEVEASLDDVNVNRFGEFLRHYASATQFIVITHRHGTMVAANVLYGVTMQESGVSRIMAVSLDQSQKEATS

SEQ ID NO: 7378 - protein, 231 aa, Lactobacillus casei
MVASEFVSELRQRYGIEFHDLSLLDEAFTHSSYVNEHKELGLKDNERLEFLGDAVLELTVSDYLYRKFPDKPEGDLTRIRAAAVQTAAFSAFSKEAHFDRYIKLGKGEEKAGARKRLTLLEDLFEAFNGALYLDQGRKANIKFAEQIIFPKIDAGEFSANQDHKTALQETLQQNGDVAIVYHLLDEKGPAHERQFHVDVEVEGRVLGTGFGKNKKAAEQAAAKAALARLKK

SEQ ID NO: 7379 - protein, 597 aa, Lactobacillus casei
MKKRSVLGMITLATALSITLVACGSKSSNSSSSTSNKSVKFPISYNNTAKAVKGGNVNVAVVDDSPFKGVFNEELYTDQYDYYYMNPTAESLFAYNSKFKFNNKGAATLKQDNNAKTITVTIKPNVKWSDGQPVVARDLVYAYEIMANKATKSQRYTESLQNIEGLTEYHDGKADSISGLTMPKGDNGNTMVIHFKQMKPSFGTSGNGYFLENAAPYHYLHDIAFDKLESSDKVRKQPLFFGPYKVSKVVAGQSVQYTPNKYYWKGAPKLDKITMENVSSASITSALKNHKYDVVYGMPSDTYNDWKSIAGYTNLGHQALAYNYLGFKLGKWDDSKNENVYNPKAKMANKSLRQAMGYALNNDEVASKFYNGTRTRATTLIPPVFGKDVHADINGYDLNIKKANSLLDKAGYKKGKDGYRTDPNGKKLTINFATMAGGSTAQPLAQDYIQQWKKIGLRVKLTTGRPIEFNSFYDKIQKDDKSVDVYAAAWSLSSDPSPMDLFSAKAPFNYTRFVSAENTKLLNDIDGQKAMNPTYRAKALKAWQKYANDEAFAIPTLYRAEIFPVNKRVKNASVDYASANYLNWSKLAVTSNSTAKK

SEQ ID NO: 7380 - protein, 303 aa, Lactobacillus casei
MQNNANEVAANTTKIEQSPSNFKVILNEFRKDKVAVVSLFLAVAIILAAFIGSMLFNVGGATQVNIMDRYTSPGVNGYILGTDEGGRDMFKYLFFAARNSITIGISVALIIEFVGVVLGTISGYFGGWIDSVIMRLVDFWMIIPSLLVIIVLVTIVPQYNVISIILIMAAFYWMTTTRLMRSLVLSEARSEYVMASKTSGTSNFKIMFTGVLPNISSLIITDLTLTIASSIGIETALSFLGFGLPMETPSLGTLIGYASNPDLIFNRWWVWFPAVLVLLTLSLSINFVGQALRRAADSRQRRG

SEQ ID NO: 7381 - protein, 320 aa, Lactobacillus casei
MWKTILRRILIMIPQLILLSVLVFVLSKMMPGDPLSGNFQQGQSAAQMAALRQQYGLNDPWYIQYVKWVGNMFHGDLGQSFVYKRSVTGLIGERAVNTFWLALMSTVILYVIAIPAGVIAGRYEGSKRDSAISVASFILMAVPPFVFYLLGLIFFGFFLQWFPTGGSVSSTYNPGTIGYVWDRIYHMILPALVAGIITTPSTIQYLRTGVIDNTHQDFVRTARSKGVPDRVIFNKHILRNSLLPIAAFMGNQITMLLGGSVILETVFSYPGMGQLFVSSMTSRDYPVVISLVLLFGFLTLLGNLLSDIIMSIVDPRIRIE

SEQ ID NO: 7382 - protein, 317 aa, Lactobacillus casei
MAMIEVRNLKIHYPIRSGFFNRVTDHVLAVDGIDFDIEQGETYGLIGESGSGKSTTGKAIVGLEPVTSGSIMYKGQDITKRSVRKHMQYNKDVQMIFQDSLSSLNPRKRIEDIIAEPIRNFQNLTKDEERHRVQELLDIVGMPSDALYKYPHEFSGGQRQRIGVARAMATNPKLIIADEPVSALDLSVQAQVLNFMKRIQEEYNISYLFISHDLGVVKHMCKKMAIMHRGRFVEIGTREDIYNHPQHIYTQRLLSAIPDVNPDDREENKEHRREVERIFKEEESKYYSKEGRVLDLQKISDTHYVALPDSTMKGVHD

SEQ ID NO: 7383 - protein, 340 aa, Lactobacillus casei
LDKPEDLLLDVQHLHTGFRLGDAFYDAVDDVSITLRKDEILAIVGESGSGKSTLATSIIGLHDPRNTKVTGDILYNNLNLVGLNETLFDRIRGKDIGMIFQDPLAALNPLMRIGEQIEETLVYHTKMNKEERDKRVLELLNQVGIPNPERTARSYPHELSGGMRQRIVIAIAIACKPPIIIADEPTTALDVTIQAQILDLLEDIQREMHSGIILITHDLGVVAETADRVAVMYAGQIVESGSVMDVFKHPTHPYTRSLLRSMPQADSDDDELHVIQGVVPSLKNMQMEGCRFAPRIPWIPASAHEEHPTMHEVAPDHFVQCTCYKDFYFPDDDQAAEKGE

SEQ ID NO: 7384 - protein, 80 aa, Lactobacillus casei
MSEDEIYQKIAGLIQDHFQLSPDKISPSLNFKQDLDADSIDIVEFVLELEDAFGAEIPDDDAEKIQTVQDAVDYIKAHQK

SEQ ID NO: 7385 - protein, 349 aa, Lactobacillus casei
MKIAIDAMGGDHAPEVVIAGTEKARDHDADLEFILYGDEAKIKPLIHNQDRLTIVHTAEKINSDDEPVRAIRRKKQASMVLAAQAVKQGDAAAMVSLGSTGALLAAGLFIIGRIKAIERPGLLPTLPTVDGKGFVMLDVGANAENRPYHLLQYAIMGSYYAKDVRGVDNPRVGLLNNGTEANKGDKLHQEAHDLLAAAPGINFVGNVESSDILNGPADVVVTDGFTGNATLKAIEGTVRTVMHMLKGAIYDGGVSGKLGGLFLKNNLKSMAQTFDISSYGGAVLLGLKAPLVKAHGAADADTVYYTLLQTAKMVKNGTVAKVVDYFDAHPEIAEAKTTDKAVDNDAGNK

SEQ ID NO: 7386 - protein, 679 aa, Lactobacillus casei
MALTDPVSVLPGVGPKREEGLASLGIHTVGDVLFYFPYRYDDLKVKDLAEATDQEKLTIKGVVVADPVISRFGPHRSRVNVKLQVERSVILVTFFNQPWLKDRFQMGDEAAIFGKWDAQRRSLTGMKILATQSRDQPSMAAIYTVNKNIRMGTLLDLIKAAWARDHQHIHDLIPASIREHYRLMTDEQLVHGMHFPDTPQEAKAARRTGVFREFFLFQLQIQALKQLNTNSSNGLAIPYDNQALRALIATLPFSLTNAQKRVVNEICADMRRPNHMNRLLQGDVGSGKTIVAAIVLYAAVTAGYQAALMVPTEVLAEQHFAKLQKLFVNFPVKLGLLTGSTTAKRRRELLTDLRMGTLNLIIGTHALIQKGVDFKALGLVVIDEQHRFGVNQRKVLQEKGQKPDLLSMTATPIPRTLAITAYGEMDVSTIDELPAGRKAITTTWLRKNQVGQVYQLIRSQVQAGSQVFAITPLIAESEKIDLQNAEQLFADMQKAVGNLGQVALLHGKMKPDEKDRIMRAFSQGDIAVLVSTTVVEVGVDVPNATVMAIFDADRFGLSQLHQLRGRVGRGNKAAQCLLIADPKNEQGIARMQIMTKTNDGFLLAQKDLEMRGSGDIFGDKQSGLPEFKVADPVGDFPTLEAAQQIVARIFKTDPHLLEPEHQPLAAYLAASRQMNGSLD

SEQ ID NO: 7387 - protein, 558 aa, Lactobacillus casei
VAVTEITATKFQDMIRVAAHRINKNADFVNSLNVFPVPDGDTGTNMNLTFQTGAKAVLESNDAGVGDLAKHLGKGLLMGARGNSGVISSQLFRGFAKSVEGKKSLTAQDLADAFAHGVETAYKAVMKPVEGTILTVAREAAKAGLKAANGSDDALVVMTAVVKGAKRALAKTPDLLAVLKEVGVVDSGGQGLVFIYEGFREGLSGEVSSDVHDVTDEEMTEMINAVHHQSAQTQLDPADIVYGYCTEMMVELETGDHFKHFDYEPFRNYLNTLGDSTLVVADEEVVKVHVHTEHPGTVFRYGQQFGELMKIKVDNMRLQQESIIEREGSLDAHANDQPLAEMGVVAIAAGEGLGELFKSLGVTYVLNGGQTMNPSTNDILDAVKAAHAKHVIVLPNNGNIFMAAEAAAKAATDVEVAVVKSKTINQGMTAMLGYNPDADLATNQSEMTAQLPNVISGSITQAIRDTTINGLAIKNHDWMGIIDGTISVTDQDRQQAAIAMVNKMINDDSEIVTIIVGADANQGEAKKIADAVGKAHPDLEFEIHQGDQPVYPYLVSVE

SEQ ID NO: 7388 - protein, 120 aa, Lactobacillus casei
MAVKIKTKYGIIDISNNVIATVVGGAATSIYGIVGMASRNQIRDNLNDILKRENYARGVVVRQTDNGVKIEVNIIVSYGTKISEVCRNVQDKVKYNLETMLGVTTDEVTVIVQGVKVLGD

SEQ ID NO: 7389 - protein, 61 aa, Lactobacillus casei
VAKDVITGRHTTFGNKRSHALNSSRRTWKANLHKVRILVDGKPKRVWVSARALKSGKLTRV

SEQ ID NO: 7390 - protein, 222 aa, Lactobacillus casei
MTDVNIMAGGPHENLSENWQQLAGEWIGVDRGTLRLVKAGIKPVLAVGDFDSLTASEFQLVRERVQKIEQVPSAKDDTDTELAVKAALTDFSADKVTLVGATGGRLDHFLSNLFLPLQPRFLDDIERIHLLDEQNRVDYYDPGKHEIQPLPGYRYVAVINLTPVTALTIIGAKYPLKAWDGAFPYAWASNEFIGNEPFTVSWTAGQVAIIYSRDRIGQKVDN

SEQ ID NO: 7391 - protein, 216 aa, Lactobacillus casei
MKIAPSILSADFAHLARDVEKVEGAGADLLHVDVMDGHFVGNLTFGPLVVQALRPVTNLPLEVHLMVSDPGVWAPEFAKAGADTILVHEEATSHLYGVLQHIRAAGVRAGVVVNPGTSLSSLDEVLPLVDQVLVMTVNPGFGGQKFLTPMVDKVARLHKIRQERDLHFVIEVDGGINDQTVKAAAAAGTDIFVAGSYVFGAPNVSDAITSLREAVK

SEQ ID NO: 7392 - protein, 301 aa, Lactobacillus casei
MSDELTGRIIKQISGYYDIAVGETVYRTRGRGSLRNDNITPLVGDFAAFQPGHGDDEGYLLRILPRQNALARPPVANVDQALLITSAVEPDFSLNLLDRFLVYLEGHAIHAEIYLTKTDLAPAKLLEKIRTSLTGYQAIGYAVFAPEHVFDQAVLKQVHASFADKLTIFTGQTGSGKSTLINHLVPGLDLATASISRALNRGRHTTRTTDLYPIHGGLVADTPGFSSLGLLDVTLDDLRDRFPEFVALAPNCKFRGCQHVSEPHCAVKAALAAGKIMASRYENYLQFREELSGKRPVYKKK

SEQ ID NO: 7393 - protein, 663 aa, Lactobacillus casei
MIEPGTILNEHYKLIKTLGEGGMANVYLAHDLILDRDVAVKVLRLDLQNDPDTVRRFQREAMATSELVHPNIVSIYDVGESHGQQFLVMEYVKGSDLKHYIVEHFPIPYQRVVDMMEEILSAVQTAHDHNIIHRDLKPQNILIDANGHAKITDFGIAVALSENSMTMTNSLLGSVHYLSPEQARGSMPTRQSDIYALGIILFEMLTGSVPFEGDSAVSIALKHFQEEVPSVRAFDPHIPQALENVVFKATAKNPANRYTSAEAMASDLNTALSPARAHEAKYVIPKDDLDETRVVPIVPNGPTPPHNSDGGADQPADQSAPENRPKQKRRRWLIVAISAVVVLLLLIGIGVVTANQKADVTVPDLRGMTTAQAKTALKSARLKVGKYRYAYSTKVDKDLVIDSDPKRQVSVKESSSVNLILSRGQPRITLDNYVGQDYSDAKSDLQKRGVTVKEKLIKTNEASAGKILSQSIKAGKKVIASKTTITFEVAEPVKVKKVNTSFALRDLTGYTEKSLRDYANEVGLKIVISQSYSDTVDTGMVISQNPAAGTQVQSGATVNVTISQGADPDEVKTVSKTISIPYQAPSAASGSASASASSSGVTPNGIQVFIGDKTHNISDINKTFNITADDQVTITLQVSKKYPGSYRVVRDGTVIAQEANITQ

SEQ ID NO: 7394 - protein, 247 aa, Lactobacillus casei
MEFAYRTDIGRRRPNNQDYVGIFKNQSEATLALVADGMGGHRGGDVASEMAVSHLGYAFEKTDTAEIESIVRWLIFELQQENDMILQKAKQYTDLSGMGTTVVAVIISGTRFVVANIGDSRGYLYRNGHLIQITEDHSLVNELVKYGELTPEEAKRFPQRNVISRSLGVSSDVDADVTIYDMEYDDYLLLCSDGLTNMVDNESIAAVLREDMPIGSKAQELILQANAAGGPDNISALIIHQDRREPS

SEQ ID NO: 7395 - protein, 446 aa, Lactobacillus casei
MKPNNPRLLAVQTLTRVVGKGGYSNLTLDHIITKYRLDSRDAGLLTNIVYGVIQHQLTLDYLLHPFVKNRQLDPWVRCLLQTAVYQLQYLDKVPARAVFFDSTEIAKQLGHQGIAKFVTGVLRQAQRTGFPDPASISDPIERLAITSSTPLWLVKKLQEQLGVAKTASVLAAINQPAHASIRVNTTKITPDALLKILQPSFPELRESPLTPIGLIAPGGHLAGMPEFAAGDYTMQDESSMLVAPSLDIQPGDAVLDACAAPGGKTTHIAQYLDPDQGGRVTALDLHANKIRLVQQNANRLGLADRVSAQMLDARQVDATFAPESFDKILVDAPCSGLGLIRRKPEIKYTKQADDPRHLQQIQLAILNSVAPTLKIGGRLTYSTCTMVKEENQDVVAQFLAAHPEFEQVPVLTLKPLTKAHGAPALQLFPDDYDTDGFFIASMIRRK

SEQ ID NO: 7396 - protein, 318 aa, Lactobacillus casei
MTSVIFLGTPDFAVPILEGLIDQNYNVVAVMTQPDRKVGRKQKVAASPVKQAAVAHDIPVLQPEKLSGSPELAKAIALAPDLIVTAAYGQFLPTKFLQAAQIAAVNVHGSLLPKYRGGAPIQYSIINGDAETGVTIIEMVKKMDAGDMFAQAKLPLTRQDDTGTVFTKLSLLGRDLLLATLPKIIDNTATRTPQDPEKVTFAPTITKEQEHLNIHLPAQALDQWVRALRPDVGGYVYMNGQRAKLWAVTPLSEKTDLPAGSVVERSKHQLVVAAGDQTTFQIDELQPAGKGKQHIADYLNGPGRDLTVGQQVITDEAK

SEQ ID NO: 7397 - protein, 805 aa, Lactobacillus casei
LATIAKVIVDVPTMQTDRPFDYLVPQRLDGALQAGMRVWVQFGKGDRKVSGMVVAIANQSQYDGELKPLLDVLDPAPVLNHEMLGLSKWLAETTYSFWIACMQTMLPAMLKIDAVKVAEPLGLSADERTRYFGQADSVAMNTLSDEQQIALMKLAQAGKVAISYIKKDRARVKKVFYLVPQLSPEQAEEQKNQVRKNAVKQLELLSFIKTWSAEHQRPLLTEVEHRHHLTKSVINQAAAKGWLKLEAHETYRDPYPQLQHQPLTQPLPLTDEQQAVVKTINAAVKAKEPETFLLEGVTGSGKTEVYLQVIAQVLAAGQTALMLVPEIALTPQMVDRVKGRFGMHVAVMHSGLSDGEKYDEWRRIARGEAQVVVGARSAAFAPLKHIGVFIMDEEHETSYKQDSSPRYHARDVLLKRAQIHHAPVVLGSATPSLESRARAAKGVYTLLRLPHRINDQPLPPVHIVDMRESFAQGGQEDFSAPLLDALKLRLQRHEQSVLLLNRRGYSSFVMCRDCGYVAKCPNCDISLTLHMDTHTLKCHYCGHEEAIPRRCPQCGSDKIRYFGTGTQKVEAQLQKLLPDARILRMDVDTTRRKGGHARILNAFGAHQADILLGTQMIAKGLDFPDVTLVGVINADTALGLPDFRASEKTFQLLTQVSGRAGRADKPGEVFVQTFNPDHYAIQYAKRQDYEGFFRQEMAVRHQGNYPPYFFSTKIGVSHVDETQAAKAIFSLAKELRDRLSDQVIMLGPTPGPIARLKNRYIYQIVLKYKHEPTLAETLQHILEETQQSSRQGFQVTIDPEPLSFV

SEQ ID NO: 7398 - protein, 399 aa, Lactobacillus casei
MKKQQIALFVTGGIAAYKTPLLVRALVKAGHDVRVAMTTSAEKFVTPETLAIVSKHAVLTDGHEFDHPEHVAHVALARWADLGVIVPATANTLAKLAAGMADNVVTTTLLAMAAPKLMVPAMNDQMWQNPQTQHNITKLTAQQGYLLLPPATGQLAEGYVGVGRMPEPDQIALYIESLDEPLLKGRHIIVSAGGTKERLDPVRFLTNDSSGKMGTAIANAAAGAGATVTLVTTKQLPVVPGVTVKPVTSAQSMADAIMIEFEEADAVVMAAAVADYRAPTISDHKLKKVDANSGLTLTLVQNPDILATLGQKKTHQLVIGFAAETNDLLANAQVKLTKKKADMIVANAVDATHGFNADTDAVTLLRPNQPPVTLPEMSKQQVAVALIKQLATMLPKQKG

SEQ ID NO: 7399 - protein, 82 aa, Lactobacillus casei
MIIYPSIDKLLEKVPSRYSLAVLAAKRAHELESGDLKMLSDYKSDKSVGKALEEIAAGDVVIDPKSKLLERDAEKLDHKEQA

SEQ ID NO: 7400 - protein, 208 aa, Lactobacillus casei
MHERGMLIVLSGPSGVGKGTVRQAMLNGNYRDFQYSISMTTRQMRPGEVDGVDYYFRTKAQFEHEIATGGMLEYAKYVDNYYGTPLKYVNETLDSGRDVLLEIEVNGAMQVRKKCPNGVFIFLTPPDLGELRHRLKGRGTDDDETIDKRIRKAASEITMMENYDYAVVNDKVDLAVKRIERIIESEHLRVPRVIDRYKGMLASADLAR

SEQ ID NO: 7401 - protein, 227 aa, Lactobacillus casei
LTLAVVFGGGAAHGAYQAGVWTVLGPQLAPTFVIGSSIGAINAAATARMTPFQLARWWQYFTARKMTGPVFARRNFVPLLDQMLKMPKRDDRAVLVVTTSLPDFKAHVTRLDVLDAVDAREWLLASSAMPGVFTPIKRQGVNFVDGGVVNDLPVDLARDIGADFVVAISGEGIGRIGHDHGDCYLKPSRRLPQLFDFRPSAIAAMLELGRQDAKKALPRMTFLLPHQ

SEQ ID NO: 7402 - protein, 100 aa, Lactobacillus casei
MENKSSALQSVTQHLVASYREIFDLAAPTARMPMHQVDLFIDQAMQRHYKVALFFNHESSPFVGHIIRTLGNNRFLVKAYHSNVFRVMTSTSVNFIKRFD

SEQ ID NO: 7403 - protein, 565 aa, Lactobacillus casei
MLQELAIHDFAIIDNLALSFQPGMTALTGETGAGKSIIIDAVGLLAGGRGSVDFIRTGTAKASLEGLFDAQANPATEAKLQAYGVMDPDQKDTVLLQRELFRSGRNVCRVNGHLVNTATLKAIGETLVDIHGQNEHQQLMHSETHLGLLDAFAGDDLLKIRQQYAEVYHNYQHTLQAVKQKQANEQEWAQRLDMLKFQVNEIQSADLHPHEDTDLSTERERLANFQKINSALQESYALLSDEEVNALDQIGQAMSSMQSIADLDPDFAAIADNLQSAYYSLQDVQNDLSNELDDQEFDEGRLDEVEKRLDLFNQLKRKYGETLDEVIAYGKRAAAELSQMEQAETSVEDLDSTLKESRAQLQKLGSALSKRRHAAAKQLTKAIHEQLASLYMDKTVFSVHFTKAKDFRPDGLDEAVFYIQTNPGEEAKPLAKIASGGELSRLMLAMKTIFARSEGVTAIIFDEVDTGVSGRVAQAIANKISLIAKSSQVLCITHLPQVAAMADHEYVISKNVHDGRTTTQVNKLTAKARVDEIARMLAGEKITKLTVEHAEELLKMADEFKHGRT

SEQ ID NO: 7404 - protein, 150 aa, Lactobacillus casei
MRKRERQATIQRLIRDEPIERQEDLVARLNDLNIPVTQATISRDIKEMQLIKVPAGEGHYRYSMPVEKQLPATDKLKRTLVTAMKWGEAMDNFVHLALLPGTAAAVETLIEQLDDQRIFATISGDASILIICRSAQYASAVLSELEAMVG

SEQ ID NO: 7405 - protein, 276 aa, Lactobacillus casei
MEKVKKERVDVLLVEQGLFESREQAKRSVMAGEVYDQNNQRLDKPGVKIPGDAILHVKGKKMPYVSRGGLKLAKALKSFHLDLTGKTVLDIGASTGGFTDVALQKGAKMSYALDVGYNQLAWKLREDPRVKVMERVNFRYSKPEDFTDGPVEFAMTDVSFISLKLILPPLKAILIPDGHAVALIKPQFEAGPAHVGKHGIVRDPQVHRDVLKMIVDFASATGYNVLGLDYSPIKGGEGNIEFLIHLQNAEQIPGKVAPTVDIEATLKAAYAELKRP

SEQ ID NO: 7406 - protein, 282 aa, Lactobacillus casei
MNPILSQWRTAVEHTLDETLAQVPNPHLRAAMAYSVDAGGKRLRPLLLLSVVAMYDGVVAEALPAAASLEFVHTYSLIHDDLPAMDNDDLRRGKPTNHKQFGEALAILAGDALLTDAFALLSQHYPDKRAALIQILAEAAGSSGMVEGQVLDMDGERVQYDLATLKHMHQAKTGALIQAAVAMGTVFVTIPEADQAALADFAAAFGLGFQIKDDINDVTKTTAELGKTADKDVAEHKNTFPELLGLKGAEQALAAQIQQADAALKSLTVDAAALQSILAVLK

SEQ ID NO: 7407 - protein, 75 aa, Lactobacillus casei
MAEPTFEEKLAQLEAIVNQLEQGDVPLEKALDQFKAGVKLSQELEKTLKSAEKTVTEMVSDDGTTQPFQPKEGQQ

SEQ ID NO: 7408 - protein, 449 aa, Lactobacillus casei
MVDTDQYLSVTALTQYLKRKFDADPYLAKVYLTGEISNYRKRVGNQYFSLKDDHAKIGALMFRNAFSKLQFNLEEGMKVLAVGRVSLYEPSGEYRLIVERLEPDGVGALYQAFEQLKKKLASEGLFDRNKRPLPLFPKRVAVVTSPSGAVIQDIMTTVARRYPILQLTLFPAVVQGDQAADSIVKQLNRIKAMSDFDAVIIGRGGGSIEDLWPFNEEKVARALVDMPIPIVSSVGHETDTTITDFIADRRAATPTAAAEIVTPVTLVDALNRISEDRVRLVNAMHNRLKNAASRLQRSAESVVLTQPDRLYDQYVQRVDQLRQRLNQSMVNQLHENDHRLAMATQQLDGRQLLIKVVNLKRQLLDDQHRLDRAVISVVKAKRQAVANAALGLDHLSPLKILGRGFAYVTDDTGQMLKKTDDYAVGADIHIHVADGQIGAHVTTKEKNHG

SEQ ID NO: 7409 - protein, 283 aa, Lactobacillus casei
VATRLDGKVVSKRILSELQQTVTGLAQQGVTPTLAVILVGSDPASQVYVRNKQRRAEEIGVRSLMFKLPEETSQETLLAKVAELNQDPDVDGILVQLPLPKQLDERVVINAIDPDKDVDGFSPVSVGRLWTNEPTVVASTPYGIMALLDAYQIDVTGKRVVIVGRSNIVGRPLAGLMVNHDATVTIAHSKTRDLKALTREADILVVAIGVPHFIGADAVKPGATVIDVGISRGADGKLHGDVDADAVEPVAGALTPVPGGVGPMTIASLMAQTVELAKRRLHG

SEQ ID NO: 7410 - protein, 135 aa, Lactobacillus casei
MESRHAIREAAFRALFALATNPEADKSAVYAEVLPKDTEVPPYLSELVEGVLTHQEALDAALTPQLKKGWTLSRLTKPDLMILRLGLYEIRYEEAMPEAAAINEAINLAKRYSDDQSAKFVNGILANFIEASPKA

SEQ ID NO: 7411 - protein, 151 aa, Lactobacillus casei
MAEETNIILANRTDAQGTIEIVPEVLEVILGIAASQVDGVYQMRGTLGSSINAWFGRANHGKGVSVTVADDKITADVYVYLDYGVSVPKVALAMQEQLREQLLFMTDLTLSEVNVHVVGVIPEKTEKVNPDDLFKDDDTDEPSTTSSKDDD

SEQ ID NO: 7412 - protein, 187 aa, Lactobacillus casei
MISVNDFKNGLTIEVDGDLWRIVEFQHVKPGKGSAFVRSTLKNLRTGAVQEKTFRSTEKVEKAQIDSKNMQYLYADGDNYVFMDTDTYDQLTLPGDEIRDQLNYLKENMNVKIIMHGNETLGIELPKTVDLTVKETEPGIRGNTSSGGSKPATMETGLVVQVPFFINTGDVLTINTDDGTYISRANN

SEQ ID NO: 7413 - protein, 355 aa, Lactobacillus casei
MDRMTALQARILDKKLDGFFVTDATNVTYLTGFTGEESALLVTPEKAYFITDSRFTEQFKQQVHNAKLVLHQDGLYKTAGDLANQLQLTRIGFEAVHLNYADYEAFDLLTQGTLVPTRDFVETQREVKDDEELALIKKAVAIAEKGYQHVLDTIKPGMREIDIANDLDFFMRQLGASNVSFETIVASGTRSAMPHGAATEKKIAKGDIVTLDWGCIYHGYMSDLTRTFAVGEPDAKLKTIYQIVYATNQKVQQALKPGVMGRTINDLAHNAINDAGYGQYFGHGTGHGIGLSIHEGPGAWGPYLDVPAAKGNVVTDEPGIYVPDLGGVRIEDDLVVTADGNQSLSQPAPAELLVL

SEQ ID NO: 7414 - protein, 96 aa, Lactobacillus casei; identical to SEQ ID NO: 1820

SEQ ID NO: 7415 - protein, 116 aa, Lactobacillus casei
MIKAIFHRDEHGDIVSFELSGHADAGKTGKDIVCAAVSAVSIGAVNGVEALAGFKPDVDADEVHGGHLQMTLKSAITGEQLHISQILLENLLLELQSIQDQYPDRILITTKQLKQN

SEQ ID NO: 7416 - protein, 103 aa, Lactobacillus casei
VYAIIKTGGKQYKAEVGEAIYVEKLDAEEGKQVTFDEVIMVAGEGDAKIGTPTVAGATVTGKVEKQGREKKVVTYKYKPKKHSHQKKGHRQPYTKVVIDAINA

SEQ ID NO: 7417 - protein, 40 aa, Lactobacillus casei
MGYRIQLNMKTQEFIAIDPHNAKHIGKGETIEKALQQLKK

SEQ ID NO: 7418 - protein, 553 aa, Lactobacillus casei
MDHQERQINIRWVIRQLPLTLIVVLFLLSLTSTLEPILNGVVFGQLVNIDFSNLDAVVRYVSLAAAAYLVTYTSLYLFLRAQQRAVRVLNQALKSAYFTASVAHAGTDATEVSDTINDVTGVAKQIEQAYFVGLINMLQQVIGLIIAVAFILKTNIVLSLVYVLFSALSLLPSHFGRKSLAKKSDIWANTNAGLVLSMKDIFQGRMEIFIFKAWPVFFTRFKQHLSQEERDYERMNNFQYLFQYVSWLFAIAAFLLPLFIGLLLMAKGLFGVTTSVILTLTMTADSVVGGARSLSKYQSQIVSTSQLRVLPAAGKFEISKVDDGESNPEALEGQLDISDLTVVRDRHLILSDVNIRLEPGSKVIVTGPSGIGKTTLLKAITGQVTSQGAIRFAGQPLHAGEFVLVSQNVWLFNGTLRDNITLYQAYDDAAVLAVLRLVGLDQELGEHVLDFKIVDNGSNLSGGQAQRIAIARGLLRKSPIFLLDEISSSLDQTNADKIHRIIYTLPATVIEVAHHYQEALAQAYGVKIYEMVDHRLRLKSEDSREVATGTEAI

SEQ ID NO: 7419 - protein, 797 aa, Lactobacillus casei
MKLNQFARLTPEFSQQLTELARIGLPADPKGDFADTAAAMYAAFFPEAYQPAAKQDKFAQIAVDSRQNLADWLASGPTQMTRQNFYNVALQLLGFEAFTDFDLADPLPFMAATKLPSIDHDLLDTEDFLKASYLLLTTRTKHLVNFLDDLANRGFFKDFQSSATQPKPLLFNGKVQQVFDARQAIREVVWIESDVDSDHDGKRDLLEATIYRPKATEQGLKVPVLFTANPYFHGTNDVTAATHVPETVLAVKPHGASKAEVTATAAQIEDLPKRAVTGEATEAEAYAEENSMYAFNDYFLARGFAVVYSAGVGTRYSDGFRTIGGPEETAGAVAVIEWLTGKRRAFTNRTAGVAIKAWWSTGKVAMTGKSYLATLAIAAATTGVEGLKTIIADAGISSWYDYYRENGLVVAPGGFQGEDADVLAVDTFSRQKSGGDMIRIKSAWERHLAAITRDQDRTTGAYTAWWDARNYRKNAANVKADVVLIHGLNDWNVKPKNAIRFWQAIADLPIQKKLILHQGQHVYVHNVRSLDFLDMMNLWLTHELLGVANDVADVLPNVIVQDNVTPQTWSAYTDFANPEAEHVTTEVNLKNDFEAATDQFTDHATATFAAQHDTSASFEKAIITPNSAYANSRLWLTQPVLERDQILEGIPHLELTLAVDAPTGILSVRLVDLGEAKRFGETAATVAANDLQLGFDFKTTDIVEFKPAAKPTPSKLITLGHINLQNPKNAYEVQQITPGQFFHVSLDLQPTHYHLPTGRQLALIIHGADMAQTIRPTKTTHYHVDLAKSTLTLPFRL

SEQ ID NO: 7420 - protein, 446 aa, Lactobacillus casei
MARKAITADEIRQTVKDENVLFLRLMFTDINGIIKNVEVPISQLEKVLNNKITFDGSSIDGFVRIEESDMLLYPDLNTWLLFPWENDHGKIARLICSVHRPDGTPFGGDPRNNLIRVVNEMKEAGFTAFNIGPEPEFFLFKLDENGNPTTKLNDHGSYFDFAPLDMGENCRRDIVLELEKMGFEVEASHHEVAPGQHEIDFKYADALDAADNIQTFKLVVKTIARKHGLYATFMPKPLHGINGSGMHINMSLFHDKGNAFYDPNTDDQLSETAMHFLAGVLRHAYALTAVNNPTVNSYKRLVPGFEAPVYVAWSGKNRSPLIRVPQSRGLSTRLELRSVDPTANPYLAIAAILQAGLDGVKNQLKPEEAVDRNIYRMQDDERKANHIQDLPSTLHNALKALAADDVVKAALGEHLYQSFMDSKNLEWSAYRQQVSEWERQQYLELY

SEQ ID NO: 7421 - protein, 120 aa, Lactobacillus casei
MAEIADLRTRSVLPIGTVMLLTDLTARQIRYYEAQGLVKPERNAGNHRTYSLNDVDELLEIRSQMADGFTLADVKRLKHPRHREDSDAEVRKVLRDELLNQSRLNQSPDPGPTIGFRQSH

SEQ ID NO: 7422 - protein, 696 aa, Lactobacillus casei
MTLHLHVGYTPTMKSVNLPTDWLPFNDYPLAAFNAVVVHAADQNVFDQLVASELPLPVFVIGHRQNDSTGQLDVTEAPRLDANLLTQITAAATHYEKTMIPAFLNDLLNFAQANPTSFATPGHHSGHYDRLAPAGYLLYQAYGDTFFASDTSDVVTSLGDMLTHGGSPLAAEQATARLYHADETYFVTNGTTGSNNIVASALLTPGDLVLFDRNNHKSFYNAALVQNGARPVYLDTLRTQRGLIGPLDLTDISANRLRQLVASIDPQKAQERHPFRLAILELETFDGIVPNVRQLLDLFGPLTDYIAFDAAWGGYEPFIPAMKPMDPLQMPLGPDDPGIIVTQSVHKQQSGFGQASQIHKKDAHIKGQPRYVTHEQFNHAYLKHVTTSYSYPLYASLVANTAINQGRRGQKIWADALQAALAFRHSLSDSRLFLAYQNPTLTAITPQKATTSAEAWAMAPNAKWHQLLHLKPNQAYLDPGKVTVLLPETATFGVSGWLVDRYLLDHGIVPEKADLNSLLFLVTPGSAATDWQHLRRVLQQFEKDYFANKTVAEALPKLVAETGEAYKDLTLRELAQQMSDFFREAKLAQQQQLLFTNTNNIPTAMTPQAADRCFVRGKFDTVPLQAAEGRIAVAGALPYPPGIFVVVPGERWRAVAIHYFETLFAGIRRFPGFTPEIQGIVTGADGEPYVQVVAEK

SEQ ID NO: 7423 - protein, 420 aa, Lactobacillus casei
MSWTDKFDPALLKMVKEVDTQIAPQLATIDGRILENQDKVLTSFQKHHVAESYLTGSTGYGHNDEGRDVLEAIYADVLGGEDALVRPQFVSGTHAIGVALLGLVRPGDDILYITGKPYDTLQEVLGLAGNGIGSPKEYGIGVDYVDLLPNGAVDNDAVKARLTAKTKVVAIQRSRGYATRDSFTVDQIAAMIKVVRSVLPNVWIFVDNAYGEFSETTEPLEVGADVMAGSLFKNAGGGMAKTGGYIVGKKDLIERISYRFTVPGLGGAEGATVGALADMYQGFFISPQTTGNAIKGAIFEAALFAKLGLDVSPTWDAPRTDLIQTVNFGNQADMVKFAKAIQANSPVDSFVTPIPEKMAGYEDEVIMAGGTFVAGSTVEFSGDGPLRPPYTLYLQGGLTYAHIKLATMGAAQSTFFDQAQ

SEQ ID NO: 7424 - protein, 319 aa, Lactobacillus casei
MDKPVNRIVMIVGPTAVGKSDLGIYLAQQLQGEVINGDAYQIYRHMNIGTAKVMPDEMAGVPHHLLDIVEPTMTYTVAKFKEAAENAITLVSERHHLPILVGGTGFYLNSLRLNLPLGGKAPPKSVRQRWQKALAEYGASWLWTQLVQRDPVAAKQIEPANTRRVIRALEVIELTGRRFSEQPQPQPLYETLVIGLTTQRAVLYERINARVDAMMVEGLEAEVANLLKTVPPDAQAMQAIGYKELVPYFKGQADLADCVALIKQHSRHFAKRQLTYFRNQMPTHWFDLVAHPEEKQAVVALVCQWLKQPVKGEENELDR

SEQ ID NO: 7425 - protein, 59 aa, Lactobacillus casei
MKHKFARGFFVGTLMTLGAIAGSVFAFKKNYVEPVETKADEINENRRKANRKRFSAHQG

SEQ ID NO: 7426 - protein, 135 aa, Lactobacillus casei
VLTYLLIFVGLFLIYWGFSWLWSYYQKSKFKAIGGEISPEEFEHTMRKAQIIDLRERNEFKAGHILGARDLPYTQLRERLGEMRKDLPVYLYDKTGVLSLRAARRLRKNGFEKISWLKGGYDNWSGKIKKSPTNY

SEQ ID NO: 7427 - protein, 320 aa, Lactobacillus casei
MNNQKLIGVDLGGTTIKFAILTQAGDIQQRWSIDTNILDEGSHILPDIVTSINEHLKLYNMSPADFAGIGMGSPGSVDIKAGTVIGAYNLNWKTLQQAKKVIESGTKIPFNIDNDANVAALGERWKGAGENDPDVTFVTLGTGVGGGIIADGELLHGVAGSAGELGHVTVDPVNGYLCTCGKRGCLETVASATGVVRVARDMAEEFAGDSKLKQTLDDGDEISSKIVFDLAKDGDRLALMIVDRVCFYLGLALANVGNLLNPKFIVIGGGVSAAGDFLLKRVDKYFKENTFPNVRETTRLRLATLGNTAGVIGAASLALK

SEQ ID NO: 7428 - protein, 84 aa, Lactobacillus casei
MKTYYDVLQLLKSFGTFIHVGKRVWDIELAALELDRLHQAKLIDDKVYLNAKVVLRHAHEQEEQDPLNHDLPLHSNQRRNDQNE

SEQ ID NO: 7429 - protein, 229 aa, Lactobacillus casei
MNYANWRSRFQNSAYVTNGILAVTILVFILETLSGGSTNTEVLIAYGARANPLILYGQWWRLITPVFVHIGLTHILMNGFSLYFLGEMTERLFGHWRFFLLYFISGFAGNVASFAFSPNTLAAGASTAIFGLLGACLMLGDTYRDNPVIRQLSRQFLLLVVLNLAFNLFSSGVDIYGHIGGVLGGFLAAGMLGAPALGRMGTVRRVASAVTLIFGLVALILFGIQRGIV

SEQ ID NO: 7430 - protein, 708 aa, Lactobacillus casei
VKYIRTPQPKRNKSHIPFRLNLLFFIAFLLLAALVAQLAYLQILNGPRLAAEVDRTNKTTVTGNVPRGLIYDSKGRALVTNKANNAITYTKSVGTKSQQMYDIANQLARLIDKPAENLTKRDYIDYYLAQTKVSKRITKKLPKQIQKLPSADSDKLYKYQVAYVRKHMPTLTPIQKEAAGLYKIMNGATQLSTVYLKNQNVTAHEVAVVGERLTQMPGVNLGTDWERSYPNGESMTSIIGRVSNEKSGLPADELNAYLANGYARNDRVGTSYLEKAYENVLKGSKSQTQVEIGNNNQIVQSVSKFKGQQGANLNLTIDSEYQKKVEKALDDTFSSVRSAGAGSLSDGAYAVAMDPNTGRILAMAGQHQDTQTHKVEDDALGVINRAFVVGSAVKGATVLGALQDGVITVDHNTQADTPIYLPGTPVKKSVYPVGTFSSLDAASALEVSSNIYMMWLAMKEGHYAYSPNNYLKLDNNIFSKMRGYFNQFGLGIKTGIDLPGEIAGLEGSTHDSSGNLLVGSALDLAYGNYDNYTLIQMLQYISAIANNGYRMRPYLVNSISQTLSDGSKGPILSTTQPSVTSKIENTQAQIDLVKQGMWQVVHGTNGWTTATSLNSLNPGVAGKTGTAQGFTRESKGSALTETITESFVGFAPAKNPKIAIAVIIPNLKAETTTPYQLQIAKEMFSDFYKMNDIKEDKGYSIHQKTING

SEQ ID NO: 7431 - protein, 864 aa, Lactobacillus casei
VRRRWLKNNPLILSFLLPGLLVGFYFAIRGVFPFGSSSVLTVDLGQQYIDFFAYLRQTLLGHPGQLFYAFNKGLGGDMFGVFAYYLLSPFNLLVILFPTDMLDVAAFLIMILKISTAGLTMGWYAKHHGINGLMISAFGLAYALSGWLLANSFNLMWLDAAILLPLIVQSAEALFTKGRNIAYIGWLAAALIINFYTGYMIALFLVLYAAYWLSAHAKSWRHAWRIGLRFIGASLLAAMCSAVVLLPTWFQLAQSKATYTVKTFQWHFEYAPDRLLSKLIPGSFNFDQMPSGFPNIYVGALGFVLAVLFFLSRQQPWRQKIAAVLVTGFLLLSCMFEPLDLLWHGFQFPVWYPYRFTFVLCFWFLSLGINSLAKIETGLSLQKLVILLIVFGLIYGDVALNLKHFSFLTFGNLVFGIGSLLLVLVWLSLDQHRPLWFGFAIVLVDMSGSMILTLNQLAYLGHRDYHDYTAALIQGANAVKEDDHGFFRIGKTTIRTRNDPMTGNYRGADQFNSLLEPALPKFFGQIGQPEDDGSVAYTNGTLITDSLLGMKYFLTPTHAQSSLPDAGQRPDLKWYRQVNQVGPWKILRSPFAQQIGFAASTDLLKQQLYSDTPVANQSFILQAALGKDTDPYFSALPLPEPTLAGVRRTTSNGTSTFTKVGKGRHTVTYRFKPQAGKCYVLTLGSHFANHLVNLKQNGNAVTLPDSFNDTITVNVTPKKGLQEQSLTFQLNKKEAWFDNVGLYQADVGTIQHDLKQLQAGGWRVKHATDTTIAADVTIHQSHQMLQTTIPTAPGWHVRVNGRPVSVKTSLGIFMAIPLKPGHYRITMRYTPPLLGWGSLITVIGLLLTTRWWFVTTRHQPYRKS

SEQ ID NO: 7432 - protein, 99 aa, Lactobacillus casei
LQLAITDKASQWFHRELNLPDQGAGIRFFGKAYGKTQVHDGFSVGMTRDDYPEHPIMSVEKDGVTYFVNPTDAWFFENLAMTVDYDAHLDEPKYEFKEE

SEQ ID NO: 7433 - protein, 221 aa, Lactobacillus casei
MIKVLIVDDHEMVRLGLATYIGVQPDLEVVDQAENGQEGVDMALKDRPDIILMDLVMPVKDGITATKEILKAWPQARIIILTSFIDDAKVYPAMEAGAASYILKTATAEEIAKAIRQTAKGERVLEPQVTTKMMNRMNHPQPQYDELTNREREVLQLIAQGKSNQEIATALFITLKTVKTHVSNILAKLDVEDRTQAAIYALKHGLVKNDQGDDGVATRDH

SEQ ID NO: 7434 - protein, 354 aa, Lactobacillus casei
MRRRMLVGFFLILLVWTILVEACLVFMLAKVTHHDFLQLLLANVLSAPLFVYLFIGALLISSGATVIVLWRQRVMRNQLDSRLAQLNAGQYQAPIFNRSQQAVAALGKQPADLLEALRQKMIRLQREIERYSNTPVRFSGETREAILTGERHRLARELHDSVSQQLFAAMMMLSALRSVAERDPKQEALQKQLDTIQKVINEAQAEMRALLLHLRPTNLEGKSLKQGIIQLLKELQTKITIKITWQLDDIKLNAATEDNLFRIVQELLSNTLRHAKADSLEVYLKRLQDMVILRMVDDGVGFDPKETNGNGNYGLANIKERAAAMGGTAKVVSVVGQGTSVEVRVPLSKDVAHD

SEQ ID NO: 7435 - protein, 234 aa, Lactobacillus casei
MRRWQLFLGIEFALLLWLGFQIITNPMALATILIGFLFLFLGMHWHRLRTFSVTFGGVLMVLGIFINPAIWLILMVAGIFLMMVLTKPKAGFSVWNHKQYVAPVTEAPGKKAGRRTIRSWAGRQTIAPSYDWDDINMVVPAGDTIIDLGDTFLPKGDSVIMIRKGFGKTRILVPVGVGVAVEHATFYGRLHFEDSDSMLHSQSVTAYSQDYDDAPRRIHIITNVVVGDLEVLAV

SEQ ID NO: 7436 - protein, 156 aa, Lactobacillus casei
MADKSYPMTAEGKKKLENELEELKTKKRPEVIERIKVARGFGDLSENSEYEAAKDEQSTLENRIVTIQTMLRYAEIIDAKAVAKNEVSIGKKVTFEEDGDEETYEIVGAAEADAFNGKISNESPIAQGLIGRKVGDKVTINTPGGEMTVTITKVEG

SEQ ID NO: 7437 - protein, 212 aa, Lactobacillus casei
MQQKKPIVIGVTGGSASGKTSVSRAIFDHFSGHSLLLLAQDAYYKRSDKPFSERKKINYDHPLAFDTPLLKHHLDELIHRHAVDQPVYDYTIHNRSDKTVHLEPKDVIILEGILILDDESLRNMMDIKVFVDTDDDIRVIRRIRRDMVSRGRTLDSITNQYLKTVKPMYHQFVEPTKRYADLIVPEGGQNQVAIDLLVTKIKAILAERGLQE

SEQ ID NO: 7438 - protein, 383 aa, Lactobacillus casei
LDRRSRHVEDKRRLRADEKKASHKIVAWVLGILFAVLVIVGLMGYRYVHSALQPVNPNGQTSVNVTVPAGSSTKQIAAKLEAKHVIKSAMVFNYYVKFHNIADFQAGSYQLTQRDSMNQVIQKLRAGGTAATAAGQLLVKEGATIEQIATSVNKLGKSNRNLTSKKFMALMKNQAFFAKMAKKYPQLLSSAASAQGVRYRLEGYLFPATYSVSAGETVEDLVEAMLAKTDSVMQSYYKSIKKQGYTVQEVMTLASLVEREGVTQEDRRTIAGVFLNRIDADMPLQSDISVMYALNTHKTHLTNKDTSVDSPYNLYVHTGYGPGPFDSPSEQSITAVLSPNDRSKHYLYFVANLKTGEVLYATTREQHDENTAKFASDNSSVNK

SEQ ID NO: 7439 - protein, 803 aa, Lactobacillus casei
MNVSYDWLKELVNVPVSPEELADKVSRTGIEIDGVKHPDAGLKKIVVGKVLTSKPHPNSDHLKLCDVDVGEAEPRQIVCGAPNVAAGQTVVVALPGARIADNVKIKKGKMRGEESLGMICALQEIGFNENVVPKSYLNGIYVFNEPLKPGSDALAALGMHDAILDFEITPNRADALGMRGVAWEVGATYAEKPHFVEKPLTEGTKPIADYLTAEVKDAHDAPSYQLRVIDHVKVKESPLWLQRRLWNAGVRPINNIVDITNLIMLAYGQPLHAFDYAKLGDKHIEVRRAKNGEPLTTLDGREHELDDRDIVITNGQVPVALAGVMGGLNSEISETTTTVVVEAASFNPVNVRKTALKYNLRSEASSRFEKGINLADINHALDAAVAWMAELGGGQSAKGTLSPTAVEAKDVVVDISLDHINHVLGTDLQEDQVTGIFRQLGFGVTVADGLFAVAVPPRRWDIHIKADLVEEVARIYGFDNLPSTLPTTTMTIGEYTPKQKRIRRTRHLLEGLGLTQAITYGLTTAKAAEQFKLQPGKPTRVDSPMTTDHAVLRMNMVTGLLDVIKYNQARKETNVAIYEQGRIFTKTGDQVRPTEIEYLGGALTGQVTTKTWNQDARPVDFFYVKGIVTHLLEDYSLAEPVRFAATQAVTELHPGQAADIFVGDTRIGFLGRLHPAFEHDNHLPETFVFQLDLDALFVAPKQEKIAQPAPKFPAVTRDIALQVAETVTNAQVMDVFRQHGGAYLKQVKLFDVYAGEHIAEGQKSLAYTLTYRRDDQTLTEDEVTQAFDRVKSALASDLAAEIR

SEQ ID NO: 7440 - protein, 348 aa, Lactobacillus casei
MDFQTKLEQLFQQNNERIKEVNSLDDLNQIRVQLLGKKGPITSVLRGMKDLAADERPKVGAFANKIRDELSAAIEARKAQLEQAVIDAKLASETIDVTLPGDPVVAGTPHIIIQIMDDLESFFMGMGYQVLSGPEVEEDHYNFEMMNIPKDHPARDMQETFYINNELLMRSQTSPMQARTMEKHDFSKGPLKMISPGLVYRRDDDDATHSHQFHQMEGLVIDKHITMADLKGTLLAMCQHVFGADRTIRLRPSYFPFTEPSVEVDVSCFRCGGKGCPVCKYTGWIEVLGAGMVHPNVLRAAKIDADVYGGFAFGLGPDRFAMLKYGIDDIRSFYTDDLRFLTQFSQEG

SEQ ID NO: 7441 - protein, 128 aa, Lactobacillus casei
VDATVTSTTDCQSQQVALCPKFQHTFEILGKKWNGLILEVLLNNGNSRFKDIAKLIPRCSDRVLVERLKELEGEGLINRLTHKDSALIEYALTDKGRALNSVMAAAHAWGDAWVTDEECHANETQKNA

SEQ ID NO: 7442 - protein, 167 aa, Lactobacillus casei
LSKKRDWQSDAEYVGYVADLLAKPEVQRLAEHPQHHYSNRLEHSISVSYQSYLIGKRLHLNVRAIARAGLLHDLFYYDWRKTKFDLGTHAFIHPRIALRNAEKLTELSPMEKDIIIKHMWGATVGLPKYKESFVVSLVDDYAAMDEVVVPWMHKLRHPIHTHLKALN

SEQ ID NO: 7443 - protein, 253 aa, Lactobacillus casei
MEYISSPKNDRIKTAKKLTVKKHQKDAGRYLLEGRHLVQEALASGQTPYDIYATEKYLDDRALKPFYDKITQISESVAEHLSDTETPQGIFAVMPRQAEQLPEPLSGQFLLLDAIQDPGNVGTLVRTADAAGIKTVIFGQGTADAFGPKVLRAMQGSQFHVRIVSAKLMPIIKALQRAGIPVYGSELNEKAKSYRKIQPSAQFGLIVGNEGNGMDPVLLKQTDTNLYIPIRGQAESLNVAVAAAIMMFHLVGD

SEQ ID NO: 7444 - protein, 124 aa, Lactobacillus casei
MLFHRQFSHEMSAPRSFLILEARDSRKGSVFLVKLAKQIVVRGRVQGVGFRWATKMIADNLNISGTIENRSDGSVFIQAAGEPLNLAKFVAQVKAGPNPYANVSTYEEKPLENIPDFHGFRVTG

SEQ ID NO: 7445 - protein, 329 aa, Lactobacillus casei
MHKSKKVFTLGIVGLLPLLLAACAPTTKQGVTLKPPTDPFFGTFYKVIGLPLQHLMEWIAGFVGTTSSYGIAIIVITLLVRLIVLPLMLRQQRTMTAYQEKQKILQPQLKIVQEATKKAKTPEQQLAANNYMRKIYSANGTSMIPSMGCLPMLIQLPIFSGLYQAIAYSPEISRATFFGIQLGHSNFIVTILATLPYIVVSLIMLQGVPPEQRKAMQTTAFLNPIMTFIFCMMYNAGLGLYFGAGGIILIIQQAIVTYIVTPNIRKRLDEEMEENPPVIVVNEHTFDDWGKVTATAGATSGSHQPADPDAIDHNKLRKRNAGKQQRPRK

SEQ ID NO: 7446 - protein, 528 aa, Lactobacillus casei
MVIKQTSTGQKKKSPRISLKVKWAVTVGVGIFVTFVTFSMILYGAMRQILLNQERRTVTDTLSTVVQRLSPVSGDLTIAQVVPRLEGTTASDQPSLPAPSESRERIFSDSVIQKLAQADVSVSVFSRDRTNIFQSRDTPITLGKVHGTEVQESHIGDFNGLVGTAPIYSATTSDLIGYVQVTNKLTAFHATMHEITLLIVGLSFAAVLISILIGYILATRFLKPIKLITNAIDVVNEEPESTVRIPALKRNDELGDLVLEFNGMLDRIQRYIDQQSEFVQDVSHELRTPVAILEGHLQLLNRWGKDDPEVLDESLKASLQEITRMKSLIQEMLDLTRADQVDVQFPNAVVDVHKTVQQVVADFRMIHPDFTFTLDDDLEKTTYVRMYRNHLEQVMIILMDNAVKYSTNRKEIHVSMAQNSGNGVALAVQDFGEGIAEKDRRRVFNRFYRVDKARSREKGGNGLGLSIAQQLIESYHGQIEVDSALGHGSIFRIDLPTITEAKAKALKAQEEAKQAAAPKGDTTIKSNL

SEQ ID NO: 7447 - protein, 228 aa, Lactobacillus casei; identical to SEQ ID NO: 1853

SEQ ID NO: 7448 - protein, 472 aa, Lactobacillus casei
MDKPQIGVVGMAVMGKNLALNIESRGNTVAIYNRTGSKTKAVVDEHPDKKLVPSYKIEDFVASLEKPRRIIMMVKAGAGTDAVIKELLPLLDKGDVLIDGGNTFFEDTMRRSAELDKSGINFIGMGVSGGELGALHGPSLMPGGQKEAYDLVAPILEAISAKADDGAPCVTYIGPNGAGHYVKMVHNGIEYGDMELIAESYNLMRNLLGLDVKEIADIFSDWNKGELDSYLIDITADILTRKDDLGSDKPIVDVILDRAGNKGTGKWSSQSALELGVPQSVITESVYARYISAMKQERVAASKVLPKPVANVSVDKKEAIEMIRKALYFSKLMSYAQGFEQMRFASEKYDWNLQYGELAKIWRAGCIIRARFLQNITDAYNKKPDLQNLLLDDYFLNIAKNYQESVRDLVGLAVKAGVPVPGFSAAISYYDSYRSPVLPANLTQAQRDYFGAHTYERTDRDGIFHYSWYHEA

SEQ ID NO: 7449 - protein, 182 aa, Lactobacillus casei
MLKWTIQELMKHDEQPLHFSTTLDVKADLQDRDPEILDVSPIQVSGDVLYDRGDFLVSVNLTGTLVVPSTRSLKPVTMPQNFTFSEIYLTDEGHADQYEDGEILMPLEESELDLLPAVEDHLLLSIPMQVLTPEEAATGDMPAGDEWEVLAEDEYKKRTEEEKKADNPFAKLKGMFPDQDES

SEQ ID NO: 7450 - protein, 378 aa, Lactobacillus casei
MQAVGMIAEFNPFHSGHAFALAKARSLTHADVVVVVMSGNYVQRGEPAIFDKWVRAEAALTHGADIVIELPVTGAVQAADQFAKAGVSALAALHVSALAFGTEHPELDYLDLARQLASADITDPGFADYTQTYATQLNAAYAKVAGITQTDPNFMLGLSYAKAVLALQVPMQLYPFGRQGVGHDEQQIKANLASASAVRQHLWQGEPVTGVVPADLISIYAEQPQYGWSQFFPWLKYRLQTADLAELRQVATMAEGLEYRFTQQIDGAHDMTEFLHRVKSKRYTYARLRRLALAITLNMTTAAVTKARRLPQLHVLGFTPTGRQYLRTVKHHLAYPLLTRVSADMLAPDGVLAMTHRADRLITAIGGVEQNYGRPPLM

SEQ ID NO: 7451 - protein, 245 aa, Lactobacillus casei
MIYTTFAEVYDKLMDQSLYLRWRDYVKQRVAPANQPLLELAGGSGFLAVLLAQSGYQVTDLDLSDDMLTLAEEKALTADVDLTLIQGDMRDLHDLPKFPVVTCFDDSICYMPDLEAVKQVFAQVAALLPSGGDFLFDAHSLYQMDHVFPGYMYNYQSDDFAFLWNSFVGEKPHSIEHDLTFFIYDEDLDAYKPLTETHKERTYPLEDYLAALQATGFEKVEVTADFGMQPVSAKSTRWFFHAKKR

SEQ ID NO: 7452 - protein, 119 aa, Lactobacillus casei
MVDAKTMLEIAVKAGDSKRAEDIVALDMRGVSLLADYFVIMSGTSDRQVQAIVDEIEEKEEAAGVDIRRIEGQKGSKWMLIDLNDVVVHVFMPEERQFYNLEKLWQSAPLVNVDQWVEA

SEQ ID NO: 7453 - protein, 199 aa, Lactobacillus casei
VNEHQYPDSLTHGLSRQEILNRLRNRLDEPRYEHCLRVEQTAIELAKRFDQDVDRAGLAGLLHDYGKEIPVETYKRVIVEDGFDPSLLQYGRGVWHGVVGVHFIQTEVGITDKQVLTAIARHTTGDPEMTPLDECIFVGDFIEPQRALPVEAKARKAAETNLEEASRIELENTLMYLIGARKLVFPKTLLTYNAFLAKE

SEQ ID NO: 7454 - protein, 216 aa, Lactobacillus casei
MEKTQSVTLTQPVISVAMREQILGVHRRKQVGLFGGTFNPIHNGHLIMAEAAGTELGLEKVYFMPDNQPPHVDTKTAISARHRVNMVQLAIADNPLFGLEGIEIRRGGISYTYQTMQELRRLHPDTDYYFIIGADMVDYLPKWAHIDELVKLVTFVGVKRRGYTPASRYPILWVDAPLIDISSTAVRERVQNGRSLRYLVPDPVIDYIQKEGLYRE

SEQ ID NO: 7455 - protein, 103 aa, Lactobacillus casei
MLTGKQKRYLRSLAMTTKPLIQVGKNGLGDAFVAGVKDALETRELVKISLLPTADDTPREVADTLQAAITGLEVAQIIGRTVIVYKEAAKTEHRRISLEVNAR

SEQ ID NO: 7456 - protein, 374 aa, Lactobacillus casei
MDTIKNDEERRCIGCGAILQTTDPKQPGYLPAATLAKADTEDDIYCQRCFRLRHYNEIAPVTLTDDDFLRLLNAIGESNALIVNVIDIFDFNGSVIPGLHRFVGDNPVILVGNKADVLPKSLNPNRLKNWLQQQAKAQGLRPVATMLASAKKGFGVDDLLNAIEKYREHRDVYVVGVTNTGKSTLINRIIKELTGVENLITTSRFPGTTLDRIMIPLDDGQSLIDTPGIIHRHQMAHFVGPKDLKLVSPTSVIKPATYQLNEGQTIFLGGLARFDYLRGGRQSFVIYTDNQLPLHRTKLANADDFYQRHVGGLLAPPQADEVAQFPPLVRFEFTPKEKSDLVFAGLGWITVPAGVTIAGYAPKGVDVLLRKAFI

SEQ ID NO: 7457 - protein, 178 aa, Lactobacillus casei
VAVFEPTWLVTNIFSLTPASLKQQGIKAVLTDLDNTLMAWDHPEGTAKLTRWLSDLKKGGIQVVVVSNNNANRIHKAMAKLQVAYVARALKPLPVGITKARKELDLKRSEVVMVGDQLLTDIWAGNLAGVRTILTQPLVESDAWNTRINRFFEGFVFKALAKKRQLNYQEDIHGHHQK

SEQ ID NO: 7458 - protein, 299 aa, Lactobacillus casei
MTRLHHVSLLTGDATATIHFYTNVLGLRLVKNTVNQENIHVRHLFFGDYQGTPGSVVTFFVIDRLGHRYDGRNQLGGIDLAIPGDSLPFWFERLQQAGCVISETADRLTLVDPSDTPVRLIAFQKTLPDHLTVPNDIPGNRQITGLINVDIPVADHEAEKAFFEAMLGQAAEHEQFKLAAGNTLTLKPSLTDDVKRFGRGSMDHFALTVDHEEALPRLGTIAAQHGYEVEEFADRGWFKSLYVRDPADNRIEFATQSPGFTLDEPLEHLGEKLGLPPKFEARRATIESYFKTKGVDFHD

SEQ ID NO: 7459 - protein, 322 aa, Lactobacillus casei
MIEHPLLGMNHVTAMASDPQAIFDFMSKTLGLHLIKKTVNQDALDTYHFYFTDDQGTAGTDMTFFTFPNQEKGKKGTNMISRASFRVPSDAALDYWLKRFAEKGVANDGISTQFDAKIINFHDQDDQQFQLISDEHNHGVAGGTPWKHNDVPEEFAITGLGPVTVTIFNLGHMQYVLTEIMGYNKIAEDGNWSLYEVGDGGHGAQVILEHREDLPIAVEGFGNIHHAAFSTDTRETLGTWIDRIKQYRLPQSGYVDRFYFKSEYFRAAPQILFEIATTGPGFLQDETYDEAGIHLELPPFLESKRDEIEKQLTPVKTDWRGR

SEQ ID NO: 7460 - protein, 213 aa, Lactobacillus casei
MAEENVNYTFVKGDPTVSPLLLLHGQGGNENDLLPIGKYLSPNSPMLSIRGRIQEQGMNRYFRHSENGGFDLANLEQETTWLFSVLNELCQKFNIDYNRFVVVGYSNGANVAARALLTRRDTFHTGIFFHPMALSTVDSQQDLSDVKVWMSHGDQDPIVPAQNFKVLTTYLKEQGADVTIFRHGQSHNLNEAELANAKSWLANSGRLQDWQRR

SEQ ID NO: 7461 - protein, 322 aa, Lactobacillus casei
MQRFGFEEYGKPNVFKSIEAPVPEPKAGQVQLQVLGFGLNPYDASLRRGEQAAFRKVKFPVIPGTDVVGRITKLGEGVTDFAVGDVVLNYRPIGGYSEFVTASTSKVYKKPTALSFLDAAALPQVGLAAFNILHYMLNLKPGETLGVVGASGGVGAILVQIAKFEKLHVIAVAGEQHREYLRQLGADQIFGYTDDLPEDAADAVVNAVFGAADHGAALKLVKPNGQYVTTAYADVDLSSKPDVTHLQLNPSKDYSVHDGFAYLTDVAQKWGLQVRVAQAFPFNVDGVIAGHEMLETHHAPGKLVVMQGRHVIHPIRKDVNHL

SEQ ID NO: 7462 - protein, 186 aa, Lactobacillus casei
MKIAVYCGANHGVNDEFLQAATQVGAWIAERGDTLIYGGKLGLMGAVAGSTLQHGGQVIGVMPQVLADRGLAMPDLTDLEVVADMGTRKARMIELADVDIALPGGPGTLEEITEAISFSRIGLNASPTVLFNQDGYYEPLHQMYQTAVDQGFFDQDAFDNLLFSSDLQEISTFIANYQPLGVRQYH

SEQ ID NO: 7463 - protein, 118 aa, Lactobacillus casei
MPRVKGGTVTRKRRKKVLKLAKGYRGAKHLLFKAASAQVMVSYRYAFRDRRAKKRDFRRLWIARINAAARMNDISYSKLMHGLKLANVDMNRKMLADLAVSDPDGFKALADTAKKALA

SEQ ID NO: 7464 - protein, 66 aa, Lactobacillus casei; identical to SEQ ID NO: 1872

SEQ ID NO: 7465 - protein, 154 aa, Lactobacillus casei
LISQTGEQLGVKSTRDALAIAEDANLDVVLVSPNAKPPVARIMDYGKFRFELQKKERDARKKQKTVTIKEIRLSPTIGEADFNTRLKNATKFLKKGDKVKVSVRFRGRAITHKDLGRKVLEQMADAVKEIATVETHPKMDGRSMFLMLAPRADK

SEQ ID NO: 7466 - protein, 231 aa, Lactobacillus casei
MTNEPQVQNPQLIHLMRLLRTDQNDDTQAAFYAGLKSAKFMLPVGTARTGDPTVVMLTDDNGHDYLPIFTDQANFAKSPDHDHFAVATIADCANFLYEDRDIFGVVINPYDENMVLSRANLFYVAKPDQAKHGEAVRISEPPRETADLVEQLREYLPKMPTVHAAYLVTMMRADDAQSLLLVVDADKDADLHALVGFAEAYLPETQQFHVSPTDNELGRYVSGEFSPFYQR

SEQ ID NO: 7467 - protein, 130 aa, Lactobacillus casei
VVIALWASWLVLFFVTKVLAASLYFVVLLVYLKLPWRTPSQRGRWLIAHRGRGLLVLMGIVMLLTALAAYGIANWWFGKIEFQPQGVAVFGSVGIVLLSWLIGLPKKLRNFRNKMNLNQQQNKGEDDDDQ

SEQ ID NO: 7468 - protein, 657 aa, Lactobacillus casei
MALDITFPDGNVKQFPDGTTVKAITEGISNSLAKKAVAGKLDGELIAYDEPIAHSGKLQIMTKDDAEGLTVLRQTAAFVLAAALKALYPDIHFGQGQATEDGFYYDTDRADGQVSVDDLPTVQKKMEEIIKANAALEPVVLSRADAFARFKDDPFKKQLVEAAGDPIKGYKLGDFVDFEEKVLLPSLKDLKHFKLLSVAGAYWQGKSSNPMLQRIYGTAYWSEKGLEDDAKRRQEAAEHDHRVIGRDLDLFFVDPKVGAGLPYWMPNGATIRRVIERYIIDKEIADGYEHVYTPVLANLDLYKTSGHWDHYREDMFPPMDMGDGEMLELRPMNCPSHIQIYNHHIRSYRELPLRIAELGMMHRYEKSGALSGLQRVREMTLNDGHTFVALDQVQEEFKKILRLIMDVYEDFNITDYSFRLSYRDPKNTEKYFDDDEMWTRSQSMLKGAMDDLHLDYYEAEGEAAFYGPKLDIQTKTALGNDETMSTIQLDFMLPERFNLTYVGKDGEEHRPVMIHRGIVGTMERFIAYLTEIYKGAFPTWLAPTQAVLIPVNNDLHLDYVNRIKRQMLAAGLRVKVDDRNEKMGYKIREAQTKKIPYTVVVGDKELNDAAVSVRRYGDEHTEEEAGNMFIDAMVAEVKNYSRDGKTKPTEAKKVLGD

SEQ ID NO: 7469 - protein, 311 aa, Lactobacillus casei
MEDMRKRLAMLMDSRQWRERYFKMVKAALQDPDVQTFLKQHEAELADDAIDRGTAKIYEFVSERNKIARGELPLAPGYQPTLVVANGLIDVAYEPTDAKLAADEEAKQASLVTSVNMPKDIHDASLTSYDPTDERVDALLAANRFVLAVVADPKTFHQGLYLSGPFGVGKTYLLGAIANDLASKGGIGTTLIHVPTFVVEMKSAIGSNTVLKKIDSVKRAQVLMLDDIGAESISPWVRDDVLGIILQYRMQEKMPTLFSSNKSMADLTESLAGTDRGNSEMLKAQRIMERIRFLAKEVTVGGENRRNPLAN

SEQ ID NO: 7470 - protein, 449 aa, Lactobacillus casei
MQRPDTFMPQAGFVLTKAGYFSDFDEKIAISLYQPLVGPIAMALYLSLWQEVKDRALVTDRRPQLWLLDLLDIDIDQLFVARVKLEAVGLLRTYTQVDSLGRYYAYELYPPVQPDAFFKDDLMGLLLYDKVGEKRYDELVAQFSLKPVRRPEWQEITANFLDVFRFDHNLSGEPSAVVAAKKAMAQNQPQLPRLGNGEGYDWELLQSLLANSNIQSGQLAKHQEALYQIAGFYGIQPPDFARLISRATDVMTGKIDLNALRRLAEQSYTRQQPQTKAQPVATKPPKVASADEALLKRAKSMPPRQFLTAAKQAKNDRMYPANNELRAVQSLSERNVFDAPTINILIDYILRTNDSINQALMDAIANSWLKANVTSPEAALQQIHTFEEQKATGKKRYQGQSKGVRQEKLPDWAKEGYQPKKKKVSEADRQTLAAQLEKLRQLGDKGGTN

SEQ ID NO: 7471 - protein, 155 aa, Lactobacillus casei
VQCPHCHHNSSRVVDSRPTDGGRAIRRRRECENCGFRFTTFERVEQTPLLVIKKNGTREEFNREKILKGLIRAAEKRPVTMEQMQGIVDSVENQLRAIGENEVSSQAIGEYVMSKLADVDDVAYIRFASVYRQFKDMSVFMQELQDMMKKEKTKK

SEQ ID NO: 7472 - protein, 200 aa, Lactobacillus casei
MTYLLGLTGGIASGKSTVSRVFKAAGYPVVDADVIARRIVEPGRPALARIVQAFGPQVLREDGKLNRAKLGEIVFSQPRRLEALNQINRPYLRAAINQALAQAKSGGAAIVVGDIPLLYEADYADAFDGVAVVTVDPKVQLDRLMARDGLTEAEAKERIASQIPLAEKAAMADFVIDNNGKSEATIAQAKALIRQLQHLS

SEQ ID NO: 7473 - protein, 282 aa, Lactobacillus casei
MPELPEVETVRRSLLPLIKNKRITAISTNWAKILINGLPTFQKEVVGAAVTTIDRRGKYLLIRLNNGETIVSHLRMEGRYYVVSDGHTPFDKHDHVTFTFQDGSQLRYRDLRKFGRMRLIHTGQEQSVPALAKLGPEPTPATFDEAAFAQKLKRHHKAIKSVLLDQTVVAGIGNIYADEVLWLSRLNPLQPADTLTKKEIHTLHDNIIKELDAAIAAGGTSAHTYVDAKGNRGSFQDALHVYDREGTPCDRCGTLIVKIKVGQRGTHYCPHCQPLHQRRRPA

SEQ ID NO: 7474 - protein, 881 aa, Lactobacillus casei
MTSQTKLLLIDGNSIAFRAFFALYNQLDRFTNQDGLHTNAIYAFNNMLEIVLKSVQPDAALVAFDAGKTTFRTAKYADYKSGRAKTPSELLEQLPYIKELLDDMGIQHYELKDYEADDIIGTMAKRADDAGWQTTIVTGDRDLTQLTTDQTTVQVTVKGVNELEAYTPEHVKEKLGITPTQIIDLKGLMGDTSDNYPGVTKVGEKTALKLLKQYGSIDNLYANIDGMKTSKLKENLINDKDKAYLSKQLATIDRDAPVTVDLADVTYSGPDLAKLREFYTKMNMNSLLKKIGGDVAKPTQPVHFSVLDDKSILALTKITEPITFEIEMLDDNYHIADQIGFFIGTKDETYVSTDVSLLTIPEVTKWLGDSKRDLTVFDGKRNIVAAHRLGLELPDIAFDVLLASYLINPDENSNDLGKIAEDHDYHDLPRDEDVYGKGAKRQVPEDKKLFAQFARKSMALFALRPDLTEDLAKQEQTDLFTDMEMPLARVLADMEIQGITLDAQTLKDMGTEFSQSIKVLEEKIYGEAGVKFNLNSPKQLGEILFEKLNLPVIKKTKTGYSTSVDVLNELKSASPIVQDILDYRGWAKLNSTYVVGLLKAQMPDHKIHTRYLQTLTQTGRLSSVDPNMQNIPARDEGKIIRKAFVPSHPDWQIFSSDYSQIELRVLSHISGDENMQQAFKNGVDIHANTAMKIFGLDSPDQVTPDMRRQAKATNFGIVYGISDYGLAQNIGISRKQAKAFIDGYFEQYPKVHDYMANMVKKAREDGYVETLFHRRRYLPQIHSRNFNLRKFAERTAMNTPIQGSAADIIKVAMIRMQKALTDAHLQAKMLLQVHDELIFEAPTAEMEQLGKLVPKIMDSAVQLDVPLKVDSHYGPTWFDAK

SEQ ID NO: 7475 - protein, 236 aa, Lactobacillus casei
MQERRVVNEAGLTQFFSRIYTLMGSGLVVTALVSYLLGVTFKADYTNFVGAHPIVFWIMLALPLILSFFVTGRRAQASPGYATLMFYLMSASFGFTFAMVAMVARTSNLAVALATTAVVFLVMSMVGHFGKRDLSKAGNIAFVALFGVIIMSLVNVFMGSTGLQMLISYAILIIFIVLTAWDTQRLKNLYLTTGSDGQAAISENSLAVVGALMLYLDFLNLFTAILQILGVGNNNN

SEQ ID NO: 7476 - protein, 340 aa, Lactobacillus casei
MIKKNWFWLSLAIGLIAFGIVLRPQQVLAADDAGFTVKTVLPANQRDTSQTYFDLRVSPNQEQDLEVVIQNRNTAPLTVLLAAQSAFTNDNGVVEYGKSPKPADPTLPVNLQEIVTLPAEVTIPALSQQTVKIHLKMPAKPFSGTVLGGLQFKAKSDDKGNEKGAVTNRYVYAVGLMLSESDQPVVPDLKLRQVAADNDHGQPAILANIQNFEAAILRNLHVSGYLYRQSGGKALYRSEKTRINMAPNSNFNFKLNLGKGPLEPGKYRLKLVAKGGGRTWNLTRTFTVSKKDADKLRELSKPETPAASIPWYLILIGGIVLGISLYAVFKKIQSIRRHKR

SEQ ID NO: 7477 - protein, 134 aa, Lactobacillus casei
MDANQCADLIKMMKKGISGALVIFAFLVSMPPGQVTASATFETEARVQIVIEPTGQRGGSLPLPDFKSIQIKSSKVPDRGSSPLSVESGDARYLPKLNEWIKNSLVLCGIGILLIASVLYGRKKVMDRLTLKKG

SEQ ID NO: 7478 - protein, 258 aa, Lactobacillus casei
MKTHTKLKFMALAALTVGMAANSAVVHADDARTVTTDGSVKIMQSDAPTRVLNPLNPKDKTPGTVANGDNTKNAGGEGLTLDYVSQLDFGQLKLDPTVATTVYAKPDQWTGQDGKTIPVPNRFQVTDKRLGADAWKVSLSASDLKSDEKDSQGKTVKLENAFITLLESSVVDGQARDASNHFGLSKAIKVYMGDGQATDVLAVNDKDVAKGTFINLFNPAKAGEGVSLTVPAESYTTKGLKSAEFTTKLTWTLTSAPI

SEQ ID NO: 7479 - protein, 1201 aa, Lactobacillus casei
VPSKHIRWCFVLLALFTGVCISCAFFAFGKQDNVQTRFRDRIANTVKATDRRMAGNTQYGKLKQPAMVPLSKTAGPALSARLLLPGARIEGQDAVFTLGEYFSTQTRSRWMKGAYEADGTSVPYSNSNIWPTIPDKVQSATRQMGLNEPNKRIDVLYNKQQIDLLFHSRTGKVTGVGSATAKYGNAIIVNGRETSANRNAMGVLSLVDSDPDGVLKVIATSGGSSDNGKINSNFGDQFYGRFEYISMRDHKFLNLGFFQDNTAGATGNTKKQDFLNQWGLNRVQPVQLGDIIKVENVEGKISYAKDSQVHTLSEAEYPNIKKAVFFQITKQGFKPMKVNQLETRVVDVPQNATDAELDATFPKALGIKYNIVAKRFRTRPDVSKPGKTKAFVRTFEVLEEDRVADFDYEVELNVIPAGDIKARDGHFVLGEQWRAKNLKRMFVSANQIDGTPVAWVDDQIELLLPQAINDKLNAKTRRIDVLFQKLPAPFLFNSNTGHIQSTQTATATYGNAIVIRGQGDEAGQSRDAGGAYVLLNDDGLKVIATSGAANDNNALNDQFKGKPYAAIAHVDMKQSSTKNLSKESLNWFNGDAKKQDFLNAWGNNRELPVEPGDVILVANEAGKIGYTQDSKEQQLTGINRPKELYFEITDKGYRPLQVNQLKPQSVNIPVHATQDEMDLRLREFFKLPAKAKLAIKRYESNPDVGKVGKASAKVVVSEKLMSGKEVEATYDVPVQVVKRATFATQPITFNLGETVTMAKLGAMLASAKEYDDRDIKWGDQKLSINRPQAIDKLLNPKNQRLTKIGNPIDVTMRFDASTGSVLSTNTMKVGYGNAIAIKGYEMTPRYAGGVLALVKEQNQLQIVATDGLDDDNREVHSIFPKQKYLSTSLYTTTGTMLTVHDRKQLAAEMTANGDTRKQQLLDQWGKGRIAATKPGDVLAVEHLENKVSWMENGVTQNMPKRQNKKEWLFEVTNKGYQLLDLNQIVFPALTFENHTDPSKVEQVIKNEVGKQQVSLKIESIDMPDLKTVGKKQIQLKVSQASVANVSQRIAYVYEIPIEVTEGSLSFVQMPKVIDFGSVRIDGQKIEVPRVGDQSTMTIKVRDGRSRKTSWTLDVQQQSPLTDSKQRTVKQSLLFFREDAHEYPLKVGTNQRIKKVSKAQIDHSFTYDAQAGLLLRIPENMFDFSADTYDFKLQWTLGDTPV

SEQ ID NO: 7480 - protein, 506 aa, Lactobacillus casei
MDLYDFIESNEARDVKLLQLLLTAGTHGCSYSRLLESLQVTPSTLAATVASLQQRLQAFDEAAQIRQCNEGKGRRLFLETQKPVLFDDLYRKLLRQSKEYQILATLLEKGKCRVDEFVAQLYMSKAAVFRKIKQLNLGLKSHAIKIKNGTLIGSEVEIRYLYYQLVLNSYDSEELAALAATFSARRYIKRFEARSKVKFSPHGEIKLCVWLDIALKRHFTGDKKFTGIPEETLHQLEVNPLYHMIRNWLFEIAKQYALALDEFEVYNIYIFVCSMDIIDFSATDPRHVEKYLALALPTVQQRNQYFMAALRQICAGFETQCSDASRIRMQYTLNQLHHRIQFFQGDFRLLAQPADRVLISDQQLQHLETLASELTAIVAKDDPCCAAPAKRLFLTQHYVRLLMVTHVQIAKPIRIGLLLNDDWLATSAVMARLKLALAGMCSVVLEIAEAPATYDLLITSFKTSSAAIAAKHHYRINEIETTYDIDQIKSLLVSIIREQTAISSQF

SEQ ID NO: 7481 - protein, 440 aa, Lactobacillus casei
MTEATYYFIGIKGSGMSALALVLHDLGHKVLGSDITQYTFTQKGLAAAGITMLPFDPANLKPGYTVIAGNSFTDDHPEIKQAKAMGLTIYRYHEFLGQLIKGYTSIGVAGAHGKTSTTGLLAHTLSGVAKTSYLIGDGTGKGVRDSKFFVFEADEYRRHFLAYHPDYMIMTNIDFDHPDYYHGFEDVYDAFETEANQVQKAIVAWGDDPWLRKLKAKVPVYYYGTSDRDDFQARNVDRDTKGSSFDAYFHDQLIGHFFVPLFGEHSVLNALAVVAVAHMEKLDAGLIARELGNFGGVKRRFAEKDIKDMIIVDDYAHHPNEIKATLDAARQKYPDKAIIAVFQPHTYSRTKAYEPQYVQVLSQADQTFLTPIFSSAREKNGNIRSEDVVAQIKGAAVIHQEDMRPLLKFHHAVVVFMGAGDIQKYEKAYESLLNEESFTK

SEQ ID NO: 7482 - protein, 791 aa, Lactobacillus casei
MAHYDGPAFLHQNNLPTPESELTNSKWKQPQDEPYHLPPQLAHAPKKPVNPRKVAEAQADLRAMSHPLPRHDRDRIASLTTPNSTVRTLPKERIDYQKIATALRPDEQSVYLFVGHGTKPSKQIEADSLAIAVTTSESVSEEEGASAATSTTASEPVASDQAAAVHEASEPQKPHAVVAAIAEPVEPQPASDAEVQATTEEDVKSAPSVEVSSMPKTSSANAGQETKPHGPNSRKAARIEALRRKHEAKKLRKALAAQKAKSVASRDAESARSAPSIPEARGAGEASTAQSQSGTAGLPASMTTSEPPVTAVSADDATTETIPPLRLLSPPVVADQAAQRDWVLQQRQRLDQTLQAFNVDAHVVAHTIGPTVTQFQVSLASGVKVSKITNLNDDLKLALAAKDIRIEAPIPGKNTVGIEIPNLKPRPVMLREVLDTPAFQQAKSPLTIALGVDLFGQPVVTNLAKMPHGLIAGATGSGKSVFINSLLVSLLYKATPQQVRLLLIDPKAVELAGYNGLPHLVSPVISDPKAASAALKWVVTTMNDRYKKLAAAGVRNLEQFNAKAKRHQEYNQVLPYLVIIIDELADLMLAAGSEIQDDIARITAKARAAGIHLLVATQRPSVDVITGTIKNNIPTRIAFMTASQIDSRTIIDTAGAERLLGRGDMLYLGNGASQPIRLQGTFVDREIDSIVDYVKARQGPRYLFDPAGLVKSAEAEASNAHEDELMPDVLDYLAGERHISTSKLQRVFSIGYNRAANLIDTLEARHLVSAAKGAKPREVYYTQAKKEEQSS

SEQ ID NO: 7483 - protein, 212 aa, Lactobacillus casei
MLITSYNQSAFGDTLIAITGPDTATQTTQQNGDVVAILNDQNQVIGYNFFKVSQWLGSLTGKGQVKLTKEQVAKLNAAIQEAGLPGQLEADDKPKFVIGKIVDFKDHPDADHLHVAQVDIGEKQVQIVCGAPNAALGQTIVVALPGAMMPDGKIIWPGSLRGVASYGMISSARELAIPGAPQRRGILVMPDELAAGTPFDAKEAAKVVAAQA

SEQ ID NO: 7484 - protein, 105 aa, Lactobacillus casei
MKELGSNTAILDEVKKPGKKMLFFSADWCSDCRFIKPAMPEIEKDFPDYEFVAVDRDKNLEVAQDMGVFGIPSFIAFNDGKEVGRFVNKDRKTKQQVEDFINGLH

SEQ ID NO: 7485 - protein, 113 aa, Lactobacillus casei
MRVSKLRSSFAVWLATGIITAGTSVMIHHRLYYRTIPNRLLANIKAGFANRGTIENSWIAMYPTTIETPSQHHIRVYTGGLTIRQHHTHQQFEFEVQPDGHLWRRHQLHLVEN

SEQ ID NO: 7486 - protein, 212 aa, Lactobacillus casei
MRLRNKTWAKPLIEAHPEMILVRPEKMPGQWQTRFAQEQPLYLEVGSGKGQFIVAMAQAHPEYNFIALELQEAAIAMILKKQVALKLPNLQLVLGDGADLTDYFADGEISGLFLNFSDPWPKTRHEKRRLTYHDFLRQYQAIMKPNALLQFKTDNQGLFEYSLVSMNNFGMTFDLVSLDLHHDKRVTDNVPTEYEEKFSADGGRIYELVAHF

SEQ ID NO: 7487 - protein, 257 aa, Lactobacillus casei
MEFELDAGWSLQPAGGSTGSAFLGVYANQKYFLKRNASPFLAALSVEHITPRLLWTRRVSTGDVLTAQEWLDGETLTREQMMQPVVASMLAKVHHSSLLKRMLRQVGGQVLDPDQLRQSLLQNFPENLAAQPRVEQALAEIQRWVPRVTVQSVCHGDLNHKNWLRANGRLYLVDWEQVALGDPAYDLADVMAHYGNHDTWPAFLAAYGANMDDHLQHRLYWYSDLHLLSDMKTAALHQRSDEVAKALRQFEVLQSTH

SEQ ID NO: 7488 - protein, 404 aa, Lactobacillus casei
MIKLWRTRLRQHVQEQQKYLRLVFNDHFVLILLILFGGALYAYSQIVKTLQPSGWLALGLALIFTGFLSLGQLATLAEAPDQIFLLPKAEAFKAYLLKARHYSMILPGVLLTFTSLAMWPLFAQLGQDPASGTMALLVALWLFKDLDLWLQFLQRYHLPIRWHHQRLLLLGIAFIALFGGFYVHPAITLLVALILNLVFRWQLKSVLDQGQLNFSALISLEEARMGRLYRFYNLFTDVPGLANSVHRRRYLDGLLKLVKPQQATTWLFLYLRGFLRGGEYLGLYVRLLVIGAVIVAVLSPWWLVLGFAILFLYMVGFQLLPFYYQYDDIVFVHLYPVAPEQKPAAFEQLLTVLLLIEVLTFTLVTLVRLQWLAAGSIFIGGGLFVWAFTRWYARMRLKQHHVMI

SEQ ID NO: 7489 - protein, 243 aa, Lactobacillus casei
MTLTIDGLTGGYGNLTILKDVSFSVPSGKIVGLIGLNGAGKSTTIKHIIGLLTPQTGTIDLDGKTLNTDPTGFRASLAYVPETPVLYPELTLREHLDMTIMAYDLDKDTAWREADAMLKRFRLDNKLDWFPAKFSKGMQQKVMIVAAFMTHAQLFIIDEPFTGLDPLAIHDLLDIVTAKKQQGASVLMSTHILATAQQYADEFVLIKSGKVRATGDMASLKQQFGLQDGSLDDIYMKMTEEKA

SEQ ID NO: 7490 - protein, 144 aa, Lactobacillus casei
MIDCIFCKIVRNEIPNVPVYEDDVVKAFLDITQVTPGHTLIVPKKHVPDIFAYDTDLAAAVFERVPKIARAIKASNPAIKGMNILNNNGKVAYQSVFHSHIHLIPRYSDQDDFGMHFGDHSAQYDNAKLEAVAAKIRNQLEAQA

SEQ ID NO: 7491 - protein, 119 aa, Lactobacillus casei
MKFRHGFLLGAVAGTIYGILTAKKTGPQRQQEIATYFNGVANGVTQVRQSINHLSETLTNLSAEVDQTLKPAMKDITNSVETFEFETAPRTDAIQEHLDKINEAVSDLGTKAPTSTAKP

SEQ ID NO: 7492 - protein, 301 aa, Lactobacillus casei
MKKWILGVVGLFVAVTLAGCSSGTVANMKGAKITKDEYYNAMKKTTTGQATLRNMIVLKALEQQYPNKVSDKKVNSQFNKLKKQYGSSFDSTLEQNGYTESSFKDQIRTTLYSEVALKDMKKPTTKQIEAQWKKYQPKIQVQHILVKTEDEAKQIISDYQKDPTEKNFEALAKKNSIDTGTKNKGGKLTAFDNTDTSLDSTFKAAAFKLKKPGDITTTPVKTQYGYHVIRAISIGKKGTMKEHKKDLENQIYTSWQSDQTVMNGVITKVLKKANVSIKDNDLKDVLSSYLSSGSSSSSTSN

SEQ ID NO: 7493 - protein, 322 aa, Lactobacillus casei
VAKRLFDYHNEEDVRLPVLIKSAEVRVAKNGKKFIAMIFQDNSGHISGKFWDATANDIAQFKAGEVVQLSGKRELYQGNPQIKIYSMRLATQEEGNDPKTFVERAPEAPNAMEEELNSFIFEITNANWNRIVRKLINDHKKAFFSYPAAKSNHHAFAGGLAFHTLSILRLAKSVTAQYSSLNKSLLYAGSILHDLGKTIELSGPISTDYTVPGNLIGHIVLIDEQIVLAAHQLKIDINGEDMLLLRHVVLAHHGLLEYGSPVRPQVLEAQVLHELDEMDASINMMTTAYQHVDPGTFTERLFGMDNRRFYRPTNGQTFPDPH

SEQ ID NO: 7494 - protein, 115 aa, Lactobacillus casei
MANVYDTANQMAEDIKSTQEFQDLKKAFDLLKLDTVAYGLFQQFQQKQYEMQQKSMQGQDFTDEEVKSLQALGDKMRDIQPIQNLMAKEQGLSQMMDELNKIISQPIIDVYQSKP

SEQ ID NO: 7495 - protein, 680 aa, Lactobacillus casei
MEFLSRVWQGIRWFFRRFQVIRWLILIGLTVILVFSAWFTYKAKTADVQNIKSTLQTKTVIYDDNNEEAGTLYGQKGTYVELNDISKQVQNAVISTEDRTFYTNGGFSIKGILRSAFNYVIHHGQIMGGGSTITQQLAKNTLLTQKQTIMRKAQELFMAIQLNKVYSKQDILAMYLNNAYFGNGVWGVQDAAKRYFGKNASQLDASEGAILAGMLRNPSYYNPADHKDNAISRRNVVLQLMVDNNKLTQAQANAAKAQSVQVVDAFSTANAQKYPSYFDSVIEEARSEGISVDDILNKGYKIYTNLDQTYQQNLQTSFEQNWAFPADAADGKQVQGASIILDPKTGGVRAVVGNRGEHTFLGFNYATQLRNSPGSTIKPLMVYTPALENGYHYDSILKDEKLSYGKNQYTPTNATGTYLGTVPMYKALADSINAPAVWLLNKIGVQKGVSSLDRFGIQLKSSDQNLAAALGGLKNGVSPLMLARAYAAFANGGKLPTTHFIRKIVDATGQTVVDNSNPPSRQIISKKVAQEMTSMMIGTFNEGTGSTAKPSGYTIAGKTGSTEVPSSWGYGTKDQWVVGYTPDIVNATWIGYPTTDSQHFLQGTSTSGVAPLFKLEMSKLMPNTPQTAFDTKDAAQMASIQTPEKNDDIWQGIQDGIDKGIDSAKQTVGKWYDNIKGWFK

SEQ ID NO: 7496 - protein, 276 aa, Lactobacillus casei
LLFQTVAIAKTHASLRDQLQSWLIPRKRQHQMRVARSIQVNGHYRHFNEPVVTGDRVAMTYDEPIRLAYVSETPHLNIRFEDDNLLIVDKPAGMKTHPNKPGETGTLMNQAAAYLAPQPALITHRLDMATSGLLVIAKNPLAQAIINRQLATKTMHRDYLAVVQRGIPKEGRIDAPIGHDPQDKRKRMIRPDGAPAVTHYQRIAETATTATVLLRLETGRTHQIRVHLASIGYPIIGDPLYALPSDEPRMRLHAYRVRLTKPLSDERLTVTSPVPF

SEQ ID NO: 7497 - protein, 151 aa, Lactobacillus casei
MNKNERQAALARIINQKPIATQEELLAALKAAGIDATQATISRDIREMKIVKAQDATGTLRYTIFRGSAESQLERLGRSIREVGLSITRVQFMNVIKTLPSNGNLLAAIIDDIDFDQVVGTIAGHDTIVVISPDERQAKWFEEAYRHAFDR

SEQ ID NO: 7498 - protein, 560 aa, Lactobacillus casei
MDFKELVVNALKPALAGQLDEAKIAALVETPKSSDLGDYAFPTFSLAKILHRAPKMIASDLVEKIDAAPFEQVKAVGGYVNFYLDKISFAHEVLKAIAQEGEHYGDAKLGKGNVPIDMSSPNIAKPMSMGHLRSTVIGNALANILAKVGYSPIKINHLGDWGTQFGKLIVAYKKWGSEAAVKADPIKNLLHYYVQFHEEAEKDPELEGEARAWFKRLEDGDDEALTLWRWFRTVSLAEFNRIYKILGVDFDSYNGEAFYNDKMDSVVKTLEDKHLLKTSQGAEIVDLSKYNLNPALIKKSDGATLYMTRDLAAAIFRKNHYHFVQSLYVVGNEQREHFQQLKAVLLEMGYEWANDIHHIPFGLITANGKKLSTRRGNIILLEKVLNDAVDLAKQQIAEKHPDLPNAQKVAHEVGVGAVIFHDLKNERLDNFDFNLEEVVRFEGETGPYVQYTNARAHSILRKADIAPAPEVALGDPAAWDVLRALGDFPAIVARAAKEYEPSVIAKYALRLAKAFNQYYANVKVLVEDSELPARLAMVKATTQVLENALHLLGVAAPEEM

SEQ ID NO: 7499 - protein, 128 aa, Lactobacillus casei
MAKTGRHYYFVARNEKTKTGYRISFPNIPNAEAVGTTYEETVYYSYRVLADFLSHLPKKEAEIRAYTLSDIPDTVSSNVFYSLVSVTPDFDPHKMETHFTLPQTPPDDIRQKAAKLAGLVTPNDNVAL

SEQ ID NO: 7500 - protein, 86 aa, Lactobacillus casei
MPDYPSNISRAQFALIQPDLENFRKHTRPRRYDLYDVFNAILYSLTTGCQWRELPHDSPEWHTVYRYYDMWRDKPDPTADSLLERL

SEQ ID NO: 7501 - protein, 238 aa, Lactobacillus casei
VTVFKELRAAGHEPVGIRIDSGDVTTLSQAARTQLDAAGFPNAKITISNALDEHIITSLLHEGAPIDNFGIGEKLITSASAPVLSGVYKLAATESNGQSTPKIKVSASREKLTIPGDKQVYRLYEPGTQRAFADLIAPATETIVDATSLTVVNSDPLSVDRQQRLTHFEVRPLLAPVDLSNTTSIPVTTIQATTQAKLAELPRTTQRLVNPDLYPVYMTTTLSQLQTSLLNKMTILAD

SEQ ID NO: 7502 - protein, 223 aa, Lactobacillus casei
MERPRIRDYFQQDLSQNETITPKQRAILQASLDLFAEKGFDQTSTSDIAQRAGVAEGTVYRRYKTKAALRDAILAPIAAHIVPILASDFSEDELRQRYPSLQAFVTAIFTDRVAFAKANVKELKVIFEMAAFDTERREQILSQIAPKMVKQMGSVINQLKADHLIVDWPNDLILQSLLSQLFGYLARLMLELPGTEIEREQAYLITVMTKILTPGEHDQITGQ

SEQ ID NO: 7503 - protein, 405 aa, Lactobacillus casei
MRTMAIVRRVFKQMLRDKRTLALMFLAPLLIMALMYFLFQNNTTQVATLGVHNVDHQVVKAINTKHVDIHHYSSNQAKAMIKQHDLDGYLTQKDGNLTITYSNSNPTNTSLIKASLQSGLVKLKIQTLVTATKAQKKVLQTQKQATVSKLKTALAQAQASGNTAAAAKIQKQLRQATASATAPTNSQSQTTTYTTSSHYIYGSSDSTFFENFLPAFLGFFVFFFVFLISGVSLLNERTTGTLSRLLATPIRRSEIIMGYLIGYGGFAIIQTVLTVVYTITVFKIHLIGSIWLVFLTNLLLALVALTLGIFISTFANSEFQMIQFIPLIVVPQIFFAGLVPVDGMASWLQAIAHIMPLYYGANALTAVVTKGAGLGDIGVNLLILVGFMVVLTMLNIVGMKRYRKV

SEQ ID NO: 7504 - protein, 247 aa, Lactobacillus casei; identical to SEQ ID NO: 2599

SEQ ID NO: 7505 - protein, 306 aa, Lactobacillus casei
MAIITLIERSQIELMQHHTIQYIAATLSRSRISIRHELHRCPEGDYCAIIAQDHADTCRHRCGRHSILTPKLKRMVTERLTLGWSPEMVGYAVHCAPHTIYHWIYQRQVDFQPSQLFDHGKCHKRRQDLRSRYNQAVGTSIEIRSESANRRTEKGHLEMDTIRGGRGSKAAVLTIVDRVTRLMATTKLENLSQNAVLKGFARLMVDFPGPVRSVTVDHGKEFSCDQALTKRYRIPVYFCHAYHPNERGTNERFNRELRYYFPKGTQFDQVSEANIQRATALINNKPRKCLRWQTPVQAVSKPLSRW

SEQ ID NO: 7506 - protein, 158 aa, Lactobacillus casei
LSSITYSERIKIETFCELGLSNIQMGVRLKRSRCGRKTKLSDELKQKILNHLRLSWSPGMIAHEFKLATKSIYNWLNQGRIGFSLNDLPEHGVRQRRNVDQRSKYNQSLGRSIEQRPMMINQRNRISDFELDTVVGPRGHSKAVLFLDCIIKVTTQKM

SEQ ID NO: 7507 - protein, 155 aa, Lactobacillus casei
MKYTKTKAVLNQLVADLSQMSMIIHQTHWYMRGPNFLKLHPLMDEFMEEIDSQLDVISERLIALDGSPYSTLKEMAENTKIQDWPGEWDKTTPERLAHLVDGYRYLEDLYQHGIEVSDVEKDFSTQDIFIGLKTAIEKKIWMVQAELGSAPEIDE

SEQ ID NO: 7508 - protein, 101 aa, Lactobacillus casei
MVDCKINPNAVRINFTIYQLNKSTIEFYLPYEDVQNALKESAQNPFIRTKDEWVVGNNECKLNKAQKRMLKDKEIYNHFNLENIPSSIKTELNKIVHDIDD

SEQ ID NO: 7509 - protein, 100 aa, Lactobacillus casei
MQIKQTKSFERELKKLVKKHFPITVLKPCLEAIVEQDVLVLKQIKDHALKGNWRGYREFRPARYGNYGKNYDNWIVIYQLDHDELILLLVATGSHEILNQ

SEQ ID NO: 7510 - protein, 92 aa, Lactobacillus casei
MSNTIIKNKTISTRVTPDISERAKANLAKQGLTVSEYIRLSLVKAANNEVRLVSFLDSPEALAAKKEAETGQVKNIGSLTDFEDWIDKLDAN

SEQ ID NO: 7511 - protein, 80 aa, Lactobacillus casei
MQQVVLPIKDSNVLKEVQDTLLNNFKAGRRNYTVFQVGKATLLRVSDVMRLKQADIFNPDGSIKQNAFIHDPQFSSQVQR

SEQ ID NO: 7512 - protein, 62 aa, Lactobacillus casei
VTNGRDAYDLILAGASLVQVGTLLQEEGPAAFTRLTRELRAVMQTKGYNAISDFKGQLKVLS

SEQ ID NO: 7513 - protein, 605 aa, Lactobacillus casei
MNEKIKVWAYFKHNSQDFARHWGAYFLLISVTNLVVGLAIIPLLTFGAQQVLRLGNVPYITLTNLGQIATAKPVTALLLLLIGLILLLFVYWQFAFLLLGIQNIHRQTHLSFRQLAGATIRKTRRLTPTTILSLIAYFVLIFPFSSIVFKTSLLAKLTIPDFIIDYIFDRWYLTVLIVVLYLLGTWLAIRLLPLLPALILNDQSPRATVVRSWRATRGQTWRTLWAVILIVIPVLVLSILLVAGLYAFQTYLDQQWQQWSLLGATINLGLLQVAMLLITVFFTVMLYQLATSQAETFHLIDSQDHVVQIPKRRRNWVFRVSAFALIMVIIGGTSLFYHAYLIGALTTQPLTISHRGVDNGNGVQNTIPALLATAKEKPDYVEMDLHETKDHQFVVMHDENLKALTGKDAAPHQLTLAEITQLTARENGHAAKVASFDQYLAAAEQVHQKLLVEIKTTPHDSPQMMDRFIKRYAKRLLANHDQVHSLDYGVVKTLRQRVPKLKTFFILPYTLVFPETPASGYTLESTTLSTTVADQAHDHHQAVYAWTINDPDDMQKMTFMDADGIITDQLRLLKTTLREMNDHPSYADQLLNYLNGFSTEDNAPF

SEQ ID NO: 7514 - protein, 227 aa, Lactobacillus casei
MEMERINANTIRVMLGNDDLAQRGITVLDLLGNHKQIESFFYSILDEVDKDHTFATNEAVTFQVMPSQSGLELLISKNGQKNDDSDTGSDDDSTDTQVPDYIRQQLQGLDANDQHDQQAVDEGGYIDAKKAPQTELVLKLKDFEDFISLAQTLRLEGGKSDLYRYKQNYYLVLTFYPNEISSNEAHDEMAVALEFGDRSPLSSAVLSEYGKRLMETSALETARYYFK

SEQ ID NO: 7515 - protein, 132 aa, Lactobacillus casei
MVILYTSPSCTSCRKARAWLKENKIPFKERNIFSDPLNVDEIKRLLMMTEEGTEEIISTRSKIFQELGINIDDLSTGTLIKLVAKYPGLLRRPIMMDDKRLQVGYNEDEIRRFLPRSVRTLELQQAQLLAGF

SEQ ID NO: 7516 - protein, 245 aa, Lactobacillus casei
MKLTVLGYLGGYPDAGHATSTYLVESGDYHLLMDLGSGGLLALEKVFDPLQLDAVLLTHYHHDHTADVGVLQYYYQLRKGTKKVSPLPIYGHTMDPLNFGSLTFGPFTQGMGYSADSTLHLGPFTITFLETQHPVPAFAVRIVESGTNKVLVNTSDTRYFPGLIPFTKSADLLMADTNFLADQPTPRWHLTAPEAGRLAKDADVKQLLLTHLPQQLDLDTLKQQAAKQAVGIPILLAADDLTINV

SEQ ID NO: 7517 - protein, 168 aa, Lactobacillus casei
MSTIQTVFGSKSFLVKLLDERHDPQLKLLKPAQSGLDYMIYDPSGRATFSAPLRYDIITSLGPTEQNGYVQFMYFNLDTDDVKVFLSKIKQLIDNHDILLGENHILLAQEVKHPDNFLMVSVWQSSNDYYEFKNTPALSSVKEFIRRAASANGFHEAGYTVIDPHQKD

SEQ ID NO: 7518 - protein, 693 aa, Lactobacillus casei
MHVWQQIKTNLVRHRHEDGLQIMIAALINAIMYAIGAVANNRLILTDASKRLGSLDIVPSLLMIVMVLLALFSISFLLYLNSLLIARRDQEIGLYRLLGLSGAKLGLTVFIESLIVGAIGFVAGVLLGLILSPLLGMVLIRLMALHTPIGFMVSPSALLDVLTLMGVVYLLVGAVNAIYVQNPLRQFIRQQDVPVAPKPQTWWRFWLGIGGFTLLVGSLLTMLRLLPISGSLMRLLPWIPGRMMLPILLVVVVAALLLGLFLVFADFLPGLVAWFQRRHEMQTRNASGISRHLIIKRLQGNAHSLWLTTLLCAVTITMLGSSVMLFQYKQELVLREIPTTVVASGVGVDNVTDVLKKAKVKPTHAVTISSKLVYAEIRLRDQVGQVREQPGVYNVVAMRDYRRAARLQKGLTPVRLRQQEAQLMLPNRTGFRPVGARRNPDRAIMLPGSDTSLRLTQTTNLFPTGSNNYFDRGLLVSDQTFDMLEGTPDRLYMAKLPKTKTARRALAQLQHLDNSQNLQEYVNIGDNELAGDDLTVTNRVRTKMNFWRNPIGLQASQQNFVSTLYGFLLFLILLLSGVFVVATGSILLLKQVIAVRQETRHFQILKHLGMDPQQIRHTIYRQAGVVFAVPLVFGIIMALCVISVMTNYLDNPPSRYLGLMIAIYAGIDWLFYQATVHVMIRMVDGPVSRWVSD

SEQ ID NO: 7519 - protein, 256 aa, Lactobacillus casei
MAILEVSNLSKIFGQRHDRVRALNDLSFQVAAGEFIGIMGPSGAGKSTLLNILATIETPSTGKVKIAGYDLEALNESQQAAFRRDHLGFVFQDFNLLDDMTVAQNVLLPLTLQRHVQPDRAERLRTVSQHLNLDPLLKAFPGELSMGQRQRVAAARAVITQPSLLLADEPTGSLDSLAATDFLRYLQQLNQQEKTTILMVTHDPFTASFASRIIFIKDGAFFAEVTRGKSREQFFDRIIDMEATVSGGGHARVATD

SEQ ID NO: 7520 - protein, 224 aa, Lactobacillus casei
VFKIMIVEDDQTISGLIADNLKKWQFEPVVVTDFNAVFDDFLQEKPHLVLLDINLPVFDGYYWVQKIREVSKVPVIFISSRNTNMDMVMAMNMGADDFLNKPFAMEVLIAKINALLRRTYNYADQGTDVLEHNGLMLNLKNGMAQVNDNEINLSKNEYKLLQILMRQHGQIVSRSRLLKDLWQDERFVDDNTLTVNINRLRKKIEEAGLKDYIQTKVGQGYIVP

SEQ ID NO: 7521 - protein, 359 aa, Lactobacillus casei
MRFRDYIKDHLWPIGGYILCVGLAAIIIWLDPQHRVKMSTLWYAVLLVTLVASAFFVAHFGRIRRFAAQLHDRQEAKDAALDWPLPGGESGLEQVVADTYNQMLTLHRQQITALLAQQQDQKDFIDSWVHEIKVPLAAVSLLAESFEGQVPDDKLDNLNLQLDQIEFYVEQVLYYSRLDSFSKDYLLHNTPLKPLVNDVVASQRNGFINKRLSFKLNGEDQTVLTDNKWLRFILAQLISNAVKYTPEGGRISATIRNTGKETQLMITDTGIGIPKDEQHRVFEKGFTGSNGRISNHKSTGLGLFLAEKLSEKLGHHLTLTSVINQGTTVTIHFPYVSYYSDPSQTVHHPKTTREQSSNS

SEQ ID NO: 7522 - protein, 192 aa, Lactobacillus casei
MTTNRLPQNPKPKEWLASDLSQQRIADYKPFNFVDGEGVRCSLYVSGCRFACPGCYNRVAQNFRYGKPYTQELEDQIIEDLSQSYVQGLTLLGGEPFLNTQVCIRLCRRIRQEFGHDKDIWSWSGYTYEELMQDSEDKLTLLGLIDILVDGRFLLAQKDLTLQFRGSANQRIIDVPATQAAGEIKLWKNLIR

SEQ ID NO: 7523 - protein, 743 aa, Lactobacillus casei
MKDSKMEHANGTTGKTSNMQHDDMADMPMDHEQMGHQAGMETMAMDQGTMAHGQMNHGDMHMSHGDMSQMDMHHGDMSHMDMDHGGGHMMHMGNLKQKFWVSLIVMIPVLLLSQFMGMNIHLGALQLPIVFPGSDWLVLILSSFLFFYGGWPFLTGAKSELQQRQPAMMTLIAMGITVAYGYSLYAFVMNHFIAPNGMVMDFFWELATLIVIMLLGHWIEMNAVMAAGNAVEKLAALLPSQAHVVHGDHVMDMPLAEVQVGTRLRVLAGEQMPADGQIVSGSSSVNESLVTGEAKAIHKAEGDRVIGGSVNGDGVIEIKVTGTGESGYLSQVMKLVQSAQANKSKAEGMADKVAGWLFYAALAVGILAFFIWLSDGAAIAFERMVTVFIIACPHALGLAIPLVIARSTSIGATNGLLIRNRQALETAKHAKFILMDKTGTLTEGKFTVAKTVAFANHDEAQVLALMAALESHSEHPLATGIKAAAKEQQLNVPAAQNVQVLKGIGLQGEVDGQAYTIVNARYLKDHQLSYDQAQADQLAAAGNSLSFLLQKDQVLGMVAEGDQLKPSSKPFVAALKRQGITPVMLTGDNHETAKKVADQLGLTDFQAELKPEDKVAQVKAYQQRGVVMMVGDGVNDAPSLAQADIGVAIGAGTDVAIDTADVVLVHSDPADILNFLSLAKATNRKMVQNLWWGAGYNILAIPLAAGILAPIGFILSPAVGAAIMSLSTIVVALNAMTLHLNRA

SEQ ID NO: 7524 - protein, 147 aa, Lactobacillus casei
METPTVDISQSEWEVMRIIWTLGPLKSSTLAAILTDKMGWKVATTKTFLGRLVKKGALVTEKQGREFLYHATVGEQASMDAAVTELFSHLCQMKIGKTLDHLITHVTLSKQDINDLQQTLTAKLPDAPAMVSCNCLPEGCKEEVHEG

SEQ ID NO: 7525 - protein, 414 aa, Lactobacillus casei
MKQVLVIGGGARESALALKFNQSPQVDHVYVAPGNPAMTLLGVEPIGIKEAEVPELIQFARDHQIDLTFVGPEVPLAAGIVDAFQEAHQPIFGVTKKLAQLESSKTFAKDFMHRHHLPTAASKTVHSELEAHAEATLMGLPIVLKKDGLAAGKGVIIAQDAAALDDAIDRLYEGHPDATVLLEQYLDGEEASVMALFNGQNRVILPLSQDHKRRFAADRGPNTGGMGAISPLPQFTTDQVKAAEALVDTTLAGMQEDGLSGQGVMYIGLIFTADGPKILEYNMRFGDPETQVLLPQIENDFYQLVTDLLNGQQPDLKLNGQAYACFVAVNPDYPGSGLKQVPVIVPKDWPIGTWLPAGVNQTENGWVSSSGRIFSVVEAASTLSEAIMKAKKAMESIQGVLDYRTDIGFHAVKA

SEQ ID NO: 7526 - protein, 507 aa, Lactobacillus casei
VKRALLSVSDKTGLVPFAKGLIERGFELISTGGTHRELAEAGVAVTSVEDVTGFPEMLDGRVKTLHPKIHAGILARRDDPKHMQALADHDIQPIDVVCVNLYPFAETIKRADVTRAEAIEQIDIGGPSALRAAAKNSDSVWAVVDPADYSAVLTGLDQDDAALRQKLAAKVFAVTAAYDAQIVHYLDPEPFPEQFTPTYHKRQDLRYGENSHQQAAFYVEPDPDPTSLAAAKQLHGKELSYNNIKDADAALAMLREFKQPAVVAVKHMNPCGIGLGETIEAAWDKAYAADPMSIFGGIIALNRQVDLATAEKMHKLFLEIIMAPGFDDDAYEILAKKKNVRLLTINTADVPEELGTETVSIFGGLLVQTRDDKTETPADMTVVTKVQPTADQLKALAFAQTVVKHVKSNAIVVAQADQTLGIGAGQMNRIGSVELALTEAQQNDNFAGAVMASDAFFPMDDCVDYAAKHDIKAIIQPGGSIRDKDSIAKADEYGIAMVTTGVRHFRH

SEQ ID NO: 7527 - protein, 189 aa, Lactobacillus casei
MKALAVFASGNGTNFEALFEASQAQDSNFRIVVVVCDRARAPVIRKAAHHQIPTIVVNFKDYADKAAAEAHILTALPPVDALILAGYMRIIGPTLLDAFPRRIINLHPALLPSFPGRQGIKDAFDYGVKVTGVTVHYVDAGIDTGEIIAQDPVRVLPGMTLAELEAAIHRQEHHTFPETVKKLIQEGAI

SEQ ID NO: 7528 - protein, 336 aa, Lactobacillus casei
MTDYKDAGVDIKAGDEAVQRIAALAKETTNENVLASVGGFAAAYRLPSVPQPTLISATDGVGTKLLLALQCDAHETVGIDLVAMVANDLLATGAQPLFFLDYMAVDHLDVARAESVVRGIAFGCQQAEMALIGGETAEMPDMYPQHHYDLAGFAVGVVSAPKRLPQDVAAGDVLIGLPSSGVHSNGYSLVRKLLAETDLGSQTLEDGSEMMQALMRPTRIYVKQVLPLMQQGLIHAAAHITGGGITENLPRVIPDGLSAHVDPQAWRRPELFDRLQHAGHLSESTMRMTFNLGIGMILVVAKESVSAVQTALPSSKVIGEVVADPAEKIHWQVAGE

SEQ ID NO: 7529 - protein, 484 aa, Lactobacillus casei
MVHEPKGLNEECGVFGIWGNPNAASITHLGLHTLQHRGQEGAGIVGLTKEGMRRHYGLGLLSEVFTNTDQLRPLMGRAALGHVRYSTAGGRVLENIQPLLFRFSDESIALAHNGNLTNAISLRRELEDQGAIFQSTSDTEVLMHLIRRQVDKPWLVQLKTALNEVHGGFAFVLLTEHGLYAAVDPHGFRPMVVGVMPDGGYIVCSETAALDAVGADFVRDVQPGELITIDDAGLHLDHFTTDTTLAVCSMEYIYFARPDSDIHGINVHQARVRMGERLAKEQPADADIVVGVPNSSLSAAIGYAKASGIPYEMGLVKSQYVARTFIQPTQALREKSVKMKLSVIKPVVAGKRIILVDDSIVRGTTSKQIVKLLKEAGAAEVHLRIASPPLRFPCFYGIDFQTTSELFAANHTVPEMRDLLNVESLGFLSTQGLEDSVGLPTTAPNGGLCVAYFTGKYPTPLDDYESDLNKEVASLKVNVAEVSA

SEQ ID NO: 7530 - protein, 738 aa, Lactobacillus casei
VAHVEMSPTAIAEKKSYLDLGLTEAEYERFAELIGHQPNDTEIGLASGMWSEHCAYKYSKPILRQFWTKNERVLMGPGEGAGVIDIGEGKAVVFKAESHNHPSAVEPYEGAATGVGGIIRDIFSIGAKPVAMLDSLAFGDLNQPHTQHLVDRIVAGIGGYGNAIGIPTVGGETNFDGSYTRNPLVNAMCVGIMDKDQIQKGKAAGVGNALIYVGAKTGRDGINGASFASSEFSDDEAADRSAVQVGDPFMEKLLMDACLEITQQHQQALVGIQDMGAAGLVSSSVEMAGKANSGMALDLDLIPQREANMTPFEIMLSESQERMLLCVRAGFEQEVLDVFAAYDLDAAVVGHVIEGHQYKLYHHGKLVCDVPVSSLTDDAPVYEQEAKQPERLANPAPDFDPIVTDPVATWKAMMAMPTIADKSSLYRRYDAQVQTNTVVLPGSDAAVIRVRGTHRALAMTTDSKGRYLYLDPQVGAAMSVAEAARNLVASGAEPLGITDCLNFGDPTKPEAFYELAEAAKGIIQATKAFNAPVISGNVSLYNETNGHAIYPTPMIGMVGLIEDLSTITTAAFKHADDLIYLVGETHGDFNGSELQKLQTGGVSGRLFDFDLEAEQTNQAFVLKAIRQHLVTAAHDLSDGGLLVALAEMGFANGLGAKIKVTLPTSWGFSETQGRFLITVAPENQAAFEALNGSAKLIGHVQAAPQFDVTTVSHQFSVALSQLQTAFEEALPWYMNQKA

SEQ ID NO: 7531 - protein, 228 aa, Lactobacillus casei
MKAAVISFPGSNCDLDLQWAVQQIAGADCELIKQDQTDLSSYDVVMVPGGFSYGDYLRSGAIARFSPVMTALKDFADAGGYVLGICNGFQILTEAGLLPGALQWNRDLNFICEPVALTVDRADTAFSNQYQVGEQLTLPIAHGEGNYYADPETLAELEANGQVVFRYIDNPNGSVHDIAGVTNAAGNVLGMMPHPERAVEALLGGTDGLGVFHSLIQQTKGADIRGTR

SEQ ID NO: 7532 - protein, 86 aa, Lactobacillus casei
MFKAKVYVTYKPSVLDPKAEVIKTALSRMDYHNVDDVLYGKYFELKLSGTEAAVRKQVDTICDQLLANVNMETYRFDLEPITEDEA

SEQ ID NO: 7533 - protein, 242 aa, Lactobacillus casei
MVKKTTLLYTGKAKQVFATEDPDVLWMAYTNQATALNGEKKAQIDHKGELNRAISTLLFKELSAAGIPTHYIDSPDATTMIVKKATMLPLEVVVRNYASGHFVTKFNVKPMMKLDPPIHEYYYKSDELGDPFMNEAQIFALHEATPEQLREVRSLTDRINAYLTKRFNEVGITLVDFKLEYGTLKDGTLVLADELSPDNFRLVDQQTGASLDKDVFRQNRGPLTPVYQEVLNRLQEKGAAHV

SEQ ID NO: 7534 - protein, 371 aa, Lactobacillus casei
MIDVVTSPATIGIIGGGQLGRMLAQSAKTMGYRVGILEPTPNSPAGQIADFQITAPYDDQAALTKLAKESDVLTYEFENVDLAALETVRHLTRIPQGTAILAATRDRIKEKTFLETHGVPVTPFAAVDSPATLKTAIAKIGLPAILKTTTGGYDGHGQQDINTLVDVPAAEKLLAHGPCILEKRQQFDREASVMITRDGRDQVRVFPIVENRHKNHILHLTLAPAPNISPVLAHKIDDLATKIALGLDLRGVLGVELFLEGDNVIANELAPRPHNSGHYSIEACNFSQFDAHILSICGLPIPPIKLKQPAVMRNLLGDDLTQAKAKWPQHPEWHMHDYGKAEIRPGRKMGHITVTDDRNVLDILKQMEAAW

SEQ ID NO: 7535 - protein, 161 aa, Lactobacillus casei
MQKVAVVMGSSSDWPTMQQVATQLTALAIPYEKRVISAHRMPDKLAEFGKQAADQGFGVIIAGAGGAAHLPGMLAANTLLPVIGVPIKTRTLNGVDSLLSIVQMPGGVPVGTMAIGDAGAVNAALFAASILALTDEALTQRLEAFRAEQTKRAEESEAALK

SEQ ID NO: 7536 - protein, 201 aa, Lactobacillus casei
MQQHKRLVVILETAIIAAFAMALTYIPHTTGVSAIELNYGLIPIAVLAMRRGAIPAAWAGFVWGILDLILRGLSGGSVLNPIQGFLEYPIAFTLVGLMGLTYAAFQKNVRGGEKVKASGYAFAGIIIGTFAKYFIHFIAGVVFWGSYAPKGMNAWIYSLIVNGGSALFSTVLAIVVVGILLTVAPQLFIAKDGKSLSTKAA

SEQ ID NO: 7537 - protein, 474 aa, Lactobacillus casei
MYLQHQTKTGLQRRTGAFSTARVRLRLVALISTMGGLLFGYDTGVINGALPFISSELKLAPGLQGWVTSSLTLGAAFGAVLVGRVSDRYGRKRLITGLAGLFFLATLASSLAPSAGWLIGARMVLGLAVGGVSVLVPSFLAEIAPTNRRGRLVTQNELMVVSGQLLAFILNAVLGTNFGNVHGIWRWMIVLAVIPAILLGVGTHFVPESPRWLMMKGRQQDAEDSLAVLRTPQEVPNELEHLKQTIAKSAEHKKVKPVDALKVKWIRRLLMIGIGLGVIQQIAGINVMMYYGTSILQMTGFGRNSALIANIANGVTAVAATIVTMQLLKHVPRRPLLIIGLIGTSLAITGVTFASRLPAGSPLRAFTTILMMMLFLAFFQGAISPMTWLLMSEIFPEQLRGLGMGTATFFLWLGNFAVGVLFPIGLAQMGMFWTFVCFIVTNIVSLLFVVIFVPETAGKSLEALHREEKARLSR

SEQ ID NO: 7538 - protein, 574 aa, Lactobacillus casei
MAEHLKGIAASDGIATAKAYLLVQPDLSFDKKTVDDPSKEINRLKQALDQSNDELKVIRAKAAESLGEEEAQVFDAHMMILADPDFTGQIESKIKDEKVNAEQAVKEVSEFFIQTFEGMTDNPYMQERAADVRDVTKRIMAHLLGRTLPNPALIDEEVIIVAHDLTPSDTAQLNKKYVKAFVTDIGGRTAHSAIMARSLEIPAVVGTDDVTKKAQNGQLISVDGLTGEVVIDPSTDEVAKFKQAAEAFAKQKAEWAQLKTAKSVTADGKHFDVAANIGTPKDLDGVLANGAEGIGLYRTEFLYMDSSELPTEDDQFEAYKKVLETMNPKPVVVRTMDIGGDKHLPYLPLPQEQNPFLGYRAIRISLDRQDIFRTQLRALLRASAFGNLRIMFPMIATISEFKQAKQIFTEEKDKLVKDGVKVSDNIQLGIMIEIPAAAVLADQFAKYVDFFSIGTNDLIQYSMAADRGNEHVSYLYQPYNPSILRLVKHVIDSAHKEGKWAGMCGEAAGDPIMVPLLLGMGLDEYSMSATSVLKVRSLMKRLSTEDMAKMADVALNENISNDENADLVKKTTGQ

SEQ ID NO: 7539 - protein, 88 aa, Lactobacillus casei; identical to SEQ ID NO: 3295

SEQ ID NO: 7540 - protein, 63 aa, Lactobacillus casei
MTQDYVALMDELKTGQRDKITVTPETFMAFRAAWTNYPDREEIVGTAKRDGVIEYHYRSVDSR

SEQ ID NO: 7541 - protein, 699 aa, Lactobacillus casei
MNPTNATDPFGFGSLDDIFRAMNQGMARPQQPNAQIPPTQAGRGGNGNNGRNGNGGKGLLGQFGVDLTEQARKGQIDPVIGRDKEISRVIEILNRRTKNNPVLIGEAGVGKTAVVEGLALKIANGDVPAKLQDRHVIRLDVVSLVQGTGIRGQFEQRMQQLIDELKQNKNIILFIDEIHEIVGAGNAEGGMDAGNVLKPALARGELQLVGATTSDEYRQIEKDSALARRLQPVMVEEPSVDETIKILKGLQPRYQDFHHVKYTEAAIEAAATLSNRYIQDRFLPDKAIDLLDEAGSRKNLTIATVDPETIKAKIADAEKQKQAALKQEDYEKAAFYRDQVTKLEDMAKKQSNLPENEVPTVTEKDMEKIVEEKTNIPVGELKAQEQAQLKNLASDLEKHVIGQNEAVDKVARAIRRNRIGFNKTGRPIGSFLFVGPTGVGKTELAKQLAKELFGSEDAMIRFDMSEYMEKFSVSKLIGSPPGYVGYEEAGQLTEKVRRNPYSLILLDEIEKAHPDVMNMFLQILDDGRLTDSQGRTVSFKDTIIIMTSNAGSTDAEANVGFGATLSGKTHSVLDQLGNYFKPEFLNRFDDIVEFKPLSKDDLLKIVSLMITDTNNNLKSQGLTIHVTDPVKEKLVSLGYNPSMGARPLRRVIQEQIEDRVADFYLDHPDAKELEARISNGEITVGEPAKAETPSKTSKK

SEQ ID NO: 7542 - protein, 97 aa, Lactobacillus casei
MRLINVTNSFRNLVSQQLSGTDARLVKVFSLGQTTVVYTEAPSHIEILFTNERRNIQREEIAFTLDRLLKKSIDEVSPIMGHHLAEVTVPKLERQAE

SEQ ID NO: 7543 - protein, 524 aa, Lactobacillus casei
MKPQELAQEVVKRRTFAIISHPDAGKTTITEQLLLFGGVIREAGTVKGRKSGHFAKSDWMEIEKKRGISVTSSVMQFNYQGKRINILDTPGHEDFSEDTYRTLMAVDAAVMVIDSAKGIEAQTKKLFKVVKQRGIPIFTFMNKLDRDGREPLDLIAELEDLLGIEGYAMNWPIGMGKGLKGLYDRVNNRIELYRREGDDRFLPLNDKGELDPSEPLTQDSIYTQTMDDIELLNDAGNQFSLKKIMSGDQTPVFFGSALTNFGVETFLNSFVKYAPEPGPKKTEQGDEVMPTNPEFSAFVFKIQANMNPAHRDRIAFVRIVSGEFERGMDVVLHRTGKTMRLNNSTEFMADSRETVSTAVAGDIVGLYDTGNFQIGDTIYQGKTPIQFEKLPQFTPEIFVRVTPKNVMKQKSFHKGMQQLVQEGAVQLYKTYHTNDYILGAVGQLQFEVFQFRMLHEYHSEVVMTPIGSRIARWIDPDQMDEKMSSSRNLLVQDIHGDPLFLFENQYAERWFADKYPDVKLTAKL

SEQ ID NO: 7544 - protein, 452 aa, Lactobacillus casei
MGSDPDGQIWGQLILIIFLTLINAGFAAAEIAVVSSSRTRMQAQADKGDRKAAKLVAIMKDSSRFLATIQVGITFAGFFASASAATTLADRIAPIFGQWSFAHEAAVILVTLILSYFSLVFGELYPKQVALQRTERVAKMSVTPISWLATLMRPFVWLLSASTQLLMKLTPMEFNHQGESVTREEMVAMIENGRNAGAIDPDEYQMFEGIISLSDTMAREVMVPRTDAFMIDAEEPDQKAIDAILNNIYSRIPVYEEDKDHVIGIVHIKNLLKEARRVGFEHVKIESVMTEPVFVPETITVDALLKEMQTRQQQIAILLDEYGGVVGIVTIEDLLEEIVGDIDDESDQAEQLYTKQTEHDYVVSGRMPISEFNDLFKTSLDVPDVDTIAGYVLTQLGAIPSTHHSEKLELAPGVMLSTGKVEGSRLVNVHIHLTDVPTLETSTEVSSKETDS

SEQ ID NO: 7545 - protein, 392 aa, Lactobacillus casei
MFDKLRHSKLMFWSVELLVLIFVVIGLTQVSFLFAPVATFFSTLLIPILSAGFLFYLFNPIVKLLQRLHISRNISILLIFLVVIGAIVLIVMAVLPNLIYQVTQFITNIPDFLKGLRSFISKASHYTWYQRLNIGKYVASLQISPSKLLSQVLGSFSSGLPGMIGSLASIVVSIITIPVMLFYFLKDGENFVPSIQRLLPRRYHAEVATVFTRLNATLSHYIGGQAIECLFVGTFTFIGYLIIGMPYAYLLGFIAGVVTIIPYLGPYIGIAPALVIAATQGWTKVLLVVLVVVIIQMTDGNFIYPNVIGRSLDIHPLTIIILLMVAGNLWGLLGTILAVPTYAVIKTVITYLYELYRFHQEHKDDEDFDDERELPEPTPQDGAQHDSELKKK

SEQ ID NO: 7546 - protein, 144 aa, Lactobacillus casei
LEIKTTTALDSPIHQDSVQIRTHVFVKEQHVPADLEVDSDEGKATYFVLYDAGLPVATARILPEANGYHVQRVAVEKVYRKHGLGKMVLTAIIKYARQHHVAFLKLGAQIQAVGFYKTLGFELTNRPEFLDAGIHHREMMLKLD

SEQ ID NO: 7547 - protein, 172 aa, Lactobacillus casei
MKQIPQQPAQLFAGHAYTTESSDQLGTFRPAWTDFEQRLGFKSLDQLAKTPNRTAMVIFSPYDTFLYWIGSLLPAGTDVPKAYDCFQLPAATAGQVKQPASQVLAKELPLATSFNKGLQIIEKAGYPLPERLGQTDHPYYLESYLLDGAAVKTVAYRLYIDPDQLTGVDEYE

SEQ ID NO: 7548 - protein, 189 aa, Lactobacillus casei
MEIGILESGFCMLIPKEGDSFAIQSYKHDGSLHRTWRDTMVLKTSEDALIGCNDHTLVTESDGRRWLTREPAIIFFHKHYWFNVIAMIREGGVSYYCNLATPFTMDQEALKYIDYDLDVKVFADGEKRLLDVDEYEAHRKMWQYPATTDRILKANVKVLVDWINHGKGPFSQAYVDLWYRRYLQLAHRI

SEQ ID NO: 7549 - protein, 265 aa, Lactobacillus casei
MGQITKITAQKRRGRYNIFLDGEYAFPVSETTLVNYQLAKGMTLTPAEEAQIKDSEVVAMGLEIGLNYINHQSRTHHEVKERLAKEEFPEDVISQILQRLTELGFLNDAEYVQRYLEANSKMGEAGPRMVRHKLEQKGIAADLLTEQLAAIPSTTWTEAAVRAGQKNLRHHQNRAFKDQLQRLRVALIQKGFDEATIAAAIEILDPQPDAESELALLKAEAAKQWRLKQHYEARIRKQKVKSALFRKGFDLDAIDDVLADLAEED

SEQ ID NO: 7550 - protein, 506 aa, Lactobacillus casei
MFEASFFDRHSLINYQLFRAMKTLPQTTISINALSRSTGLSYSQTYTAFQTVLVQLNKIIPDEAVDEANFTQFLKRVTLNQYRFALLKDSLPFEFFDDVFKNPHPDFHQFKENHQTSVSTLRRRITPFRDYLADNGVSLNSTTWAIEGDELHIRLAMFTFFMLAYRGAGWPFSADQEQQAKTLLTEINQVAPTFLLVPVQPMSKEALVVLAIQLMRIKAGHTLLPNRRMQLLFSEHDDLPDLIFTQSRFPNLSASELKAEKQFYYFMRMYFMTVTRQPQTLDRQIIDHFDETDNLVNRFVFGLLSHLNDQLKETDRQLIAESQVMIANLYRLSFNEYVLDGRFSQRIDFAQSPYEEADSSQLAAEIQRYLKKIPKSMPESIFADFPEPFVSGLYLLVKDNYPELNRDMQMVVNVLIEHDSFAKRDLLNFLDDLGFIRVVPPDAAVKPDLIITSLTKPKRVIPRLGHPFDPATPLITWMPEPTDLDYFNLYRRLKQLQRQHGSSAEL

SEQ ID NO: 7551 - protein, 126 aa, Lactobacillus casei
VKITYSNTMSKKMTATVWQNDTPHVMHVGETLDLKVQRGDKITYKVGRLNKVHAIDYQSPEAKFEIQINRSLQNAYFVVMFLMVVFLWFNRNSNLNNTMLVTAVVLGLAGYEALVYFVGYTAKPFH

SEQ ID NO: 7552 - protein, 455 aa, Lactobacillus casei
MAITVKIGQRFPLTIKRLDINGAGIGYYQRKITFVTGALPGEVVVAEVTAIHDRYLEAKVHKIRSASPDRVKPAEPLYGQIGGVELNHLAYPAQLRFKRDVVAQALAKFKPAGWQHYDLKPTIGMAHPTHYRNKAQFPVRVIDGHVRAGLYAPGSHHLIPLTHFLTQAPLTMKVVTALCQLLEELQIPIYEEKKNAGIVKTLVVRESFATGEVQVTFITNSAKLPQQTKLVTAIATRLPMVVSIAQNINPGNTSIIWGKESRLLAGQPYIHESLLGRTFQVSPQAFLQLNPAQTERLYTVAKDALELAPSDTLVDAYCGIGTVGISLADRYQTIYGMDTVPEAIADAKANAAHNGFTKAHYFVGKAETLFPKWLEEGIHPDAVIVDPPRAGLERPFIDALLNLNPKKFVYISCNPSTLARDLVPLAKHYKVDWIQSIDMFPQTARCEAVVKFTRR

SEQ ID NO: 7553 - protein, 159 aa, Lactobacillus casei
MKIYFANALFSHADFDYNAKLAAQIRAAVPDVDLYVPQENAAINNKEAYADSKMIAQADTDRLEAADLLVAILDGPVIDNGVATEIGVAYATKIPILGLYTDSRRLGATNQQKLDALQRVAENQFHYLNLYTTGLIKLNGDIYTDEAALVAAIKVRATA

SEQ ID NO: 7554 - protein, 584 aa, Lactobacillus casei
MTEKINAADAMIKVLEDWSIHNIYGLPGGSFDSTMNALYNRRHTINYVQVRHEEVGALAAAGEAKVTGRIGATFGSAGPGAVHLLNGLYDAQYDHVPVLALVGQVPTAAMNTNFFQEMNENPMFADVSVYNRTAMTAAQLPHVVDEAIRQAYKHQGVAVVTIPKDLGWEQIDDNYVSSANLYQKPLLPEPDPEQVATAWSIIKGAKKPILYVGNGARGARDEIIAFSEKTHIPIITTALAKGVVPDDYKANMGSAGRVASKPGVEVARGADMVLFLGSDFPFQPYFIAPNAKYIQVDIDASKFGRRHTVDLAVLADAKKFIKALTNVAEPLPETAWYRASLANKANWVDWMKSFEDDAETPLRVEPIFKLINEMAEKDAIFQVDVGNVTINGMRYLKANDDQAFTTSGWYATMGYALPAAIGAQSEFPDRQVWSISGDGGFAMVMQDIMTQVKYHLPIINVVLTNQSLGFIEAEQDDTHQPHSGVDLIGADYGKAAEAMGAQGFEVHTLDELKDAFAKAKDRKGPVVIDVKISNLRPIPVEQLVLDKQTQDPEAVDAFVKKYHAESLIPFRQLLEDAEKTTANV

SEQ ID NO: 7555 - protein, 397 aa, Lactobacillus casei
MKIGIDAIAMDTPDFYVDLVELAKVRGDEPDKYTIGIGQDEQAVPPSSQDIVTMGANAAAPLMTPAVRDSLGMVLVGTESGVDASKSAALFIHQLLDLPEWVRAVELKEACYGGTAALMMARDYVAGHPDKSVLVIAADIARYGLATAGEVTQGAGAVAMIVKADPRLITIEPDSVYRSASINDFWRPVYQDTAIAQGKYSTEQYLAFFQAVWDRYQTENSLTAADFAGMTFHLPYTKMGKKALDLVLPQVDDQTVKRLKERFEASTRYCRRIGNIYTGSLYLGLLSLLDHDATLQAGDRIGLFSYGSGAVAEFFSGVLQPGFKDQLQSAAHARQLDDRQQLTVPEYETLFSDKVPYDPEDYRPDPAYFRGQFVLTGVVGQERLYEKQPADSSTLPH

SEQ ID NO: 7556 - protein, 426 aa, Lactobacillus casei
MKFYEKTPEERRAQLIREGSLTQADASLFAATSSLPAATEAKLIENSIGEFSLPLGVARNLLVNGQLHQVPLANEEPSVVAAASNGARIAAENGGVVARVAPHQVVAEVVLTDLADLEAAKQTVLAHQADIKAVVAAAHPSMIQRGGGLVGVTVSVLANRFLKIRLTLDPKEAMGANYANTVAEAVAAAVKTWLDGTILVSILTNAPAELVTAIVRLDPASLATKTVSGEVIAKKIVQLSELAFVDPERAVTHNKGILNGVIGAVLATGNDTRAVAASAGAFAAASGQYQPLSRWVMHADKLEGTLQMPLPLGAVGGAIGALPLAQAARRLGGYRDLATMQQVIAALGLVQNLAALRALAGPGIQAGHMKLQANALAIAAGADERELPALVAALREEQMDLAHAKTYLANIRSNQKVGQSNNENRD

SEQ ID NO: 7557 - protein, 393 aa, Lactobacillus casei
MEKVVILSAKRTPIGKLGGELAGASAVDLGVTAARAAIKAARVDPEQLDQAIFGNVLQAGSGQNVARQIGLKSGMANRSTAMTVNEVCGSGLKAIRLGQAAIQLGEATAVLVGGTESMSQVPYYAEAMRAGHKFGDTAFVDGLSRDGLNDAFSQQPMGITAENIATRFEISRRDQDEFALRSHLRAAAAAAEGRFKSQMAPVTIAGRHGDVTVETDSAIRPDTSLAQLAKLPPVFEVGGTVTAGNASGINDGAAALILMAKSKAEQLGLHYLATITDYTEVGIDPDIMGYAPKLAIDQLLQTNSTSISSIDQVELNEAFASQSVAVMRDLGLTDEQVNINGGALALGHPLGASGARIMVSLLYNLAERDEKTGIAALCVGGGIGIAMQVVRHV

SEQ ID NO: 7558 - protein, 416 aa, Lactobacillus casei
MESMAQLEYHYGLKVRIYPSDRQKKLIKLNSDASRFVYNEMVAIGKELWQLKQVKLPIDTVQDRIKQLELRQNAKQLSNHFQFLEDKRIDSLAKANAIRNYRKAWKAFRKVHSTGVPKFHRKSYAWRYQTNCQYIQQKTAQLTNGTVCFEDCQHVLVPKLGRLRIKGSHKRLLNRKAETRIGTVTITKDAADRFFLSMQLGSDTPFMTKPAKTNRQTGIDLNTENFLTTSDGKVVANPRYYRTIRGRLAKEQRVLSRRARRAKKEHRPLRNSKNYQKQRLLVAKIHAQVLDRRKNFLHNVSTTLIKNHDLVVAEELRSKNLLKNHALAMSIADVGWRTFLGLLTYKADLYGRQFVTVNPKNTTQTCHHCDFVRGTEGTDKLTLADREWTCPKCQTHHVRDHNAAQNILIKGIAKLA

SEQ ID NO: 7559 - protein, 107 aa, Lactobacillus casei
MKSILQKVADDNKIVIEKMEVMPDHVHVLISFPPSKAPTSAIKALKGRSAFIFLKRHPEIRHSQDWGGHLWSPSYYMSTLGNMSKDVVENYINNQKYNELTKRPKRR

SEQ ID NO: 7560 - protein, 99 aa, Lactobacillus casei
MRVIDLLALLADQNKNASVLLDTQPTPSRFDDFILTTADDQPQLIFKPNLTRKAPLRVWELQLLLKKPDLQARFLYLTDANGPRALFGFIKRQNGLVLN

SEQ ID NO: 7561 - protein, 276 aa, Lactobacillus casei
MLLGLKASTDERQIRDRLQYHPDVFEFHLTENDFTAEGWNHFLKMVTWVRSQVPTVVFHHPMRFRGQRNELAMNPTKYPTRYDFMMTSSIKLMNLAKKVNATALIHGGYRVDTPGDYAGWTDVAKAQDVALARMIAFAQEAPGHVVFENSMSPIFRYGDPDFEARILRWQLPLAYDTSHTFITLHGDNDRLMASLANLKPLVRHYHLVDSMGKTHDSLPLGQGRIDWARVLPLLNPKASRIYEIGLKDQFNCEEMIASHHYLEKVAEELAAAKHPA

SEQ ID NO: 7562 - protein, 187 aa, Lactobacillus casei
MRTLLKKAYQLLWALFILALAYSFWARDILPRQLRPYGDPASFVIISLFVVVNAIWLYHHHFRFRDLKMENVDIMEGEKFEEFCAYLLKRNGFKHIQLTQASGDQGIDIIARKKGQSIGFQCKRYTGFVGNKAVQEVWAGHQFYKLDQAAVITNSDFSDSAIALADDLGVMLIDRKKLKRLMRRLPS

SEQ ID NO: 7563 - protein, 272 aa, Lactobacillus casei
MKLSAKIFAKVGQERITQYTLVNDHHMTLRFLTFGARVQQVRLPNATGFDPNLLLGFVTLEDYLHQPGFFGAMTGPLQPAEANVSGAWQNWNWAVKTSQEPDLVITFSLDLPEGADGQPGTRQLSITHRLNNANVWTIDMAIQTSASIRLHPRLVLPWLLTADPAQTMMQAKLTIASQPTAIGKQPKVYSEQDYGLAAADWQLHYLTDASATRIDPFADVGTQNNFNGILGQPHVAIGFAPEANLQAQAWELPAGATWRHHAEYHLDIRQKS

SEQ ID NO: 7564 - protein, 380 aa, Lactobacillus casei
LTDEEQQVVDLLQAMVQVPSVGAKEGQVADLIEAYLAPELQAGLIKRERVTYAPGRDNLVLTVGDPNAKRWLGVDGHMDVVDAGDESKWQFPPFSGQTKDGKLYGRGATDMKSGLAAVVVALKQVAHAQLDHGIQLMATVGEEIDNYGARQLAAAGYGDRLNGLLVAEPGNSNVDAAERGIIDYTLTAHGKAAHSSRPDLGANAIHGLFAFANAALTATAPLQAKDDPILGHATHNIDIIHGGNQINSLPESAYLRGNIRTTMIADNDAFIQALKQAAKTPVPKGVHLSLSIDSVLGAAAASPDNALIEAVQQARQRVGLDRGAVAYRTGITDAALFYHDGLDLAIYGPGNDTSHETNEYVTLQDVFDSVKVYKDVFLNY

SEQ ID NO: 7565 - protein, 201 aa, Lactobacillus casei
MTRRGKAYNIAIIGILGALIILQAYIPMVGYVQIFPAWPAISTIHLTVIIGGIVLGYGGGASLGLLWGLTSLIRAYTSATDPVTLLLFRNPIIALVPRVMVGLVAAFIFHQMFKRHQSALAQTIKMVFAGVAGALTNTLLVIGFTWLLFSSKAAQIVPGANASNLGWLLITALAINAVAEALLGGIVTPILGHALLRFRRK

SEQ ID NO: 7566 - protein, 154 aa, Lactobacillus casei
MLREAQFVDLSAIVDLYQQLTTEMATLAPDTYRPLATDNRQYFADYLQNDLARLFVTESHGKLTGFALVVLAQTSASPEFVPQHFAQLIDLFVIPDQRHHGLAKQLMAAVAAFAKSHQASFIQLNVLSANKTAREVYAKAGFEPVNLTLQKPLN

SEQ ID NO: 7567 - protein, 150 aa, Lactobacillus casei
MTNQELQARVEAISMAAFHQPFRHHAFFNARLKTTGGRFHPADMNLDFNPKLFAAYPPAITDGIIKHELVHYHLYAQHRGYQHRDHDFRQLLAAVGGSRFAPPLPTTGRQYVYVCTQCGRQFIRRRRIDVRRYACGHCRGKLRLQKTVIS

SEQ ID NO: 7568 - protein, 250 aa, Lactobacillus casei
MAELILDHVTVNVPVATEVKTLLQDVTLTVKTGDFVTVLGHNGAGKSTLFNAITGDLPVSGGTVTLAGKKLNGQRPEQRARHIARVFQDPKMGTAPRMTVAENLLLASHRGQRLSLRSRGLTAQKDRLKELAAKTGNGLAEALDKPTEQLSGGQRQALSLLMATMREPDLLLLDEHTAALDPHTSQSIMTLTNEIVSDQHLTCLMITHQVEDALRYGTRLIVLDAGQIVADFDQKRKAALTRNDVLAFFS

SEQ ID NO: 7569 - protein, 299 aa, Lactobacillus casei
MSLGVSAIGQGLLYGLIGLGLFLTFRVLDFPDMTVEGTFPFGAAVAVSAITHGISPIIATLLATGAGMLAGLATGLLTTKGRIPVLLAGILVMTGLFSINLRIMGRANLSLLHQANLFQESFLKDLPPYFNSVVIGLVVAVVVVGLLMLFLNTQLGQGFIAAGDNPNMARSLGIDPDHQMVLGLMVGNGLVGLAGGLLAQNNGYADVNMGIGIIVIGLAAIIIGEVVFGELTLSQRLVAVILGSILYRFVLLVVLALGFNADDLKLISAVVLAIAIMVPQIDHQLRLRRVLQKGVQAHG

SEQ ID NO: 7570 - protein, 331 aa, Lactobacillus casei
MKRMLGLIIIIFGFLGIAYFQSGTTTQQAQTKPTVGILQLTTHPALDAIHKGIISGLKDKGYVNGKNIKIDFQNAENDQSNLKSMSERFTQENAAATVGIATPAAQALANVNQKTPIILGAITDPVAAKLVKNVKKPGGNITGVSDQAPIAAQLKLIRQIMPDAKTLGVIATSSDDSAQTQAKMVAKLGTKEGFTVKRYAISSTNDLNQVASQMVSQVDAVFVPTDNTVASAMQTLVAAANARKVPIFPTVDTMVKQGGVATIGINQFHLGVVTGHMLADVLKGKTKPATTPIHFEKTGELILNEKQAKQLGLTLPSALVKQAETKGTVIK

SEQ ID NO: 7571 - protein, 465 aa, Lactobacillus casei
LPSMLQQIILDMVKQFSSLATDLIEGKVDLSQMVLASKQDFRSHLCQLISQVLEEKDQVIMESSYRRQFYRIKDKRERTFISSIGPLVFTRRYYEDKRTNERLFLLDEVAGIEKHSRLSLDLKAELLEDATRLSYKQSGERHGGEAKISRSAVMHVVHRSGKDISALDQLEDEPVPVPETLFVEADEDHVPHQDGTNHFLKMVYVHEGYRAIGKKFSLIRPFYITGEYPGTEGTEEIWQTVLDCIMKQYGGQMPKHFFLAGDGANWIKTGADFLPNCTLVYDKFHLRKACKQAAVGVPGNLGDILMSWAMQGHSSYLNDYFRVRLNDPQLRPSERKTVLHARTLIRHNWKQIQANHAPGFHGTSAEDHISHMLSERFSSRPMGWSQAGTDSLSQTRVFVFQGGHVFEKLEANAKRQHKAKIDIRIDDRIKVRYKSEMAKYAQAVEASFVELASGRHRGWQYGITH

SEQ ID NO: 7572 - protein, 148 aa, Lactobacillus casei
VFDKQLTPKEIDNILIIANERSIGHGHCVRFDNKRYLPHRNGELVYLPPHTKVLVIKSFTGRLYMTTDDDQVYDLFCVPKEQFMSAKFDLAPAVAPTPKRTKKIPAITHPWRRANYRDYLDSLGINRTRVKQLVAERYPYKNSQAIQV

SEQ ID NO: 7573 - protein, 145 aa, Lactobacillus casei
MNKQQIKMAHYGTTINDVVEQTQDNQEKMAPLFEPLREAIDAGKLADYDQGTYDDTRVVFREGTDAYKKLLTRLQEVAVPARLVGPHRTLIHNFAAFTEACEAMTESLKPDLEVDVTAFNAAEKAQDEAIQKFTKQIQKISAILQ

SEQ ID NO: 7574 - protein, 887 aa, Lactobacillus casei
LAKKPPYALSSQEVLQEEQTQLTGLSKETAQTRLGENGPNELAQAEKKSMLARFLDQFKDFMIIVLLAAALIAGFLLSEWADAGIILAVVLLNAVFGVFQESKAEEAIDALKEMSTPNAHVRRGDQVLTIPSSQLVLGDIVLLEAGDVVPADLRLVESANLKIEESALTGESVPVDKSTAPLDDDDVGIGDRTNMAFMNSNITYGRGVGVVVATGMKTEVGRIAGMINAAEETTTPLQENLKSLGKTLTVMILVIAVIVFAVGIWRNAASLPEMFLTAVSLAVAAIPEGLPAIVTIILALGTQKMAKRHALVRKLPAVETLGSTDIIASDKTGTLTQNKMTVEKVYYDGQLNNASDGIHGGNPLMTIMNFANDTQVQDDGKLLGDPTETALVAYGKTQSFDLNHALADEPRIDEVPFDSERKLMSTLHRRADGKILVTTKGAPDELLKRVTELATGDQAAPMSDSERDAILKANKDMATQALRVLGMAYKVIDSVPEPVNSETVENNLIFAGLVGMIDPERPEAEAAVAEAKSAGIRPMMITGDHRDTAEAIAVRLGIIDQGDDDAVITGAELDQQSDEEFAKNVGKYSVYARVAPEHKVRIVNAWQKKGKVVAMTGDGVNDAPALKAADIGIGMGITGTEVSKGASDMVLADDNFATIVVAVEEGRKVFSNIQKAIQYLLSANLGEVLTLFMMTMLGWDILAPVHILWINLVTDTFPAIALGVEPTEPGIMKQKPRGRKSNFFSGGVGPAVIWQGILEGLLTLGVYWFAITYPVHSGQAAMHADALTMAYATLGLIQLFHAFNVKSIHQSLFTVGAFRNKAFNWAILASFVLLAVTILVPGFNGLFHVTTLDWHQWLTVLSAGVTMIVLVEIVKIFERARRKRRGL

SEQ ID NO: 7575 - protein, 387 aa, Lactobacillus casei
VRHRWALWLGIVTLSALLLGAVAFVWQKKIAIPDRQAKVLSSQRHEQATHREAVQTAATHFDERLDRPIDTSAGKSFKETLTNDKFIGSALIIKQGEIIFNGGVGYADAAAKRVNGPTTLFQIGSIQKAVTAVAVMQLAEEGKLHLDDPVGKYLSGIKTGDQVTLRMMIDMRSGFALKKYQPSVMDDAGIIRWAIGNMTYLPQRNYAYQAVNYQLLAGVVEKVAGRSYEQQIRKTIIDRLGLRHTGFLPGMLTDTNRSLTYTGPVTNPYQTSIGEPELWYNRELGTGNMYTTVADLYRLLRGIDDGKVLPLSALKTLRNRDDGVYTAGIYNHSDFYSTNGTVAGQMASTAISHDGKDAVILLSNYNSHALNLHDEAVRLFQTLRQKG

SEQ ID NO: 7576 - protein, 275 aa, Lactobacillus casei
MRPLQAKIIKALGVQPTIDPETEIRRSIDFLKDYLKKNTFLKTYVLGISGGQDSTLAGTLTEKAMQEMRAETGDQAYQFVAVRLPYGEQADEADAMAAIDFMQADVVKRVNIKPSVDAMVAAVEANGSAISDFNKGNIKARMRMIAQYAIAGNMSGAVIGTDHAAEAVTGFYTKFGDGGADLTPLYRLDKRQGAALLKTLGAPAHLYQKAPTADLEDNRPALPDEVALGVKYKDIDDYLEGKQVSDHAAETIERWYQKTAHKRHLPITVFDTFWK

SEQ ID NO: 7577 - protein, 398 aa, Lactobacillus casei
MKHAKKWGWTRWLILGLFAGLVIGIAVYGSYDYFYLRPQTEAKEERARRKYETELNRHRAIEQRLQNATRQATNTTDRLMQQVIPSEAQPFLKKLEADHFSGTVLMMRKGKVILNTGLGYADAESGRLNGPESLYQIGSIQKGLTAVLLMKLVEQGKVHLTDPISRYLPGIRTGKQVTLRMMLDMRSGFSLKRNQPTQLSDAGIVRWSIANLNYGAKQYAYEPVNFVLLAGVIEKVTGHLYADLIQQEIFKKLKLTHSGFMPELYREPNQSFGYNGPKANPYSRRYVEPSLNYNRELGTGNIYTSAGDLYQIMAAINQGKIIRRSSVATLRDLNQGQYTAGVYNFGNYTLTHGVVAAQSAATVMDSSGQNAVVLLANTDQVTRDLAQALYHDMIKGVK

SEQ ID NO: 7578 - protein, 488 aa, Lactobacillus casei
MMATQLGEGLTLHTDFYELNMMNTFFERGISERHAVFEVFFRDLPFGSGFAVFAGLEHVIDYLNHLSFSEDDLAYLQSQTNYSDAFIDYLRHFKFTCTVRSALEGDLVFNNEPIWQIEGPLAQAQLVETAVLNMINYQTLVATKAARIRSVAGADPLMEFGTRRAQETAAALWGTRAAYIGGFNATSNVLAGKEFGIPISGTHAHSLVQAYGNDYDAFKAYAQSNKDVVFLVDTYDTLRSGVPAAIKVANEFKGRINFLGVRIDSGDMAFISKRVRQQLDDAGYTSAKIYASNDLDENTIQNLKMQGAKIDIWGVGTRLITAYDQPALGAVFKLVSIEDASGKMHDTIKLSNNAEKVSTPGKKQVWRITRRDDGKSEGDYVALADEQIDTDRSLYMFHPNFPYINKTVKNFEAKPLLQLIYDQGKQVYQTPPLAEVQAYATRSTNALWDEYRRILNPQDYPVDLSQRVWDNKMDLIKKVKSAVADREE

SEQ ID NO: 7579 - protein, 233 aa, Lactobacillus casei
MEVPVYIQIHNAIRADIEAGKWQVGDRIPSERDLAVTFNVSRMTLRQAIQTLVDEGILERRVGSGTYVANQKVQEKMSGVTSFTDLMQAQGKVPSSKTVSYHVAQPTSSEVEKLKLAPGEQVLRMERIRYADKVPISFETAAVPYDLVKNFTKKEMTASFYHTLEKKGGYVLGGAQQTVSAMLASERISEYLAIKRGDAILRLRQVSFLNDGTPFEYVRTQYVGERFEFYLER

SEQ ID NO: 7580 - protein, 381 aa, Lactobacillus casei
VTVTVLKHATIYTGLERIEDGYIRFDDKILAVGDMFDYKAQAGEQVVDVQGKTLIPGFIDVHAHGGYGFDAMDGDADQIDEMATKMMTHEGVTTLFATTMTQSTENIDKAMRGVKQAAERNRIIQGVHLEGPFISKVFKGAQPEEYIKNPNIDLVKQWQELSGGLVKLITYAPEDEGSREFEDYLLAHNIVPSVGHSNATREQMLQSKATHVTHLYNAQRGLRHREPGVTGHAMLEDNMYCELICDGFHIVPDMLRLAFDQKGPERIELVTDSMRSKGMPEGKSELGGQTVYVKDKQARLADGTLAGSVLMYKDAFKNAMSFMDASLFDAVEMSSVNQAREFNLTSKGTLEVGKDADINMLDRNHDLIATYSYGVKHDTED

SEQ ID NO: 7581 - protein, 265 aa, Lactobacillus casei
MTIGFIGAGNMAQAIINGLLAKKAINPADIVVHGGHPLHYEPYAAKVGVKALDSNQAVAEAADVVFLAVAPKLGAPILSAIGATLKKRHVPVISMLTGVSLAALEEALNDHDQPILRIMPNVNVAINAGMIAYAANDSVAGQLDGLLDLLNVLGKTMSLPEDQFSTFVALAGSSPAFVYLFIDSLARAGVKYGLEKSEATAIAAQAVMGSAKNVLASTQSPFDLIDQVSSPGGTTVAGLLAMEEAGLMSAVVKGVDATIAKDRQG

SEQ ID NO: 7582 - protein, 660 aa, Lactobacillus casei
MAIKATDLFKLVSLSYPIATNRGYFFQENRISEADNTYYQRLCFVNPRGQMTVYGTDQKHDRHPKLSPDQQWLAFLSQAADKTTQVFLQAVDGGVAHQLTAEKENVTDFAWQPDSKAVFLQTTIGAKKKVSQEDAKKPQPVTVTRAQYKLNGVGLLPENVTYELRVQQRRQKTSHIVMQRQHDFQIGAIAPDGKKIAFAAERLPDDPNDFSQAAYLLDLTTQQVTMVNEHLPQAELTPAAFSADSQQLLLHGSDNHLPNVSQGHLWHYDLESQKLQDVADDVDFDIPGYVNGDFQQDLSGKVADFVTADYYLTIGFDHGKTSLYAGGPDERLTPLIDGRRHVTDFALTPDHRGVVFTESTMTVPSRLVYFDLASEEETVLYDPNRRVTRTLGLVTPQTFNFNRAGFEIEGWYFPPQKAAASHPAILYVHGGPAVGYGYTFFHEMQYLAAKGYGVICPNPRGGLGYGEAFTAAVIKHYGQDDYQDCLAAVDEALKLDTTIDPERLFVAGGSYGGFMTNWIVTHTHRFKAAVTQRSIANWLSMYGTSDIGYYFTPWELEGKWSGDLSDVQGLWDFSPLAHIDFAKTPTLVMHSEDDQRCPIGQGEEFYIGLKLHGVETKFMRFPKSNHDLSRSGLPNLRIARLTAITDWFDAHQSKQETKGE

SEQ ID NO: 7583 - protein, 2161 aa, Lactobacillus casei
LKKGTLTFFLATGIVTIGLWDSTIVVQAAVKPQVGNIFIGGIGGDKSTDYKRVVDSITFKYSNDTITYDQKTDTFKIPIRFGSANIAGGLDRYLKFSYSFNDELEGKVKRVVISPDGLDTAVINQMDPTTHQFTHQWDVRTRVGGTADAVIYMQAHKITPDDWIAVQMESSRLKNLTPIRPAWNSTRVLEYKDFGPALNAKLLESMKKKAVADVATDSKAVQAEAKKKIDQVKVDDDFAKVLPQVVTGAHKEQAKDDLDGEAATVNAKIDSDPTLTASEKAKQKDAVTAETTKAKTVVDQAQDDTGVQQAKAVGIATIDAQHKPGTALDVRRSDAKKDIDAEAAKVTAAIDQDHTLTTAEKTAQKQATADEVTKAKTAIDQAKTIEAINQAKTDGIKAIDVQHQSGADFDKQKEQANQALDAEAKKVTAAIDQDATLTAAEKQGQKQAVAKAADSAKAAVDKVQDMDHLNQAKADGIKAIDDQHQAGVALPARQDTAKKAIDAEAAKITTAIDKDPTLTTAEKKTQKQAVVDATAKAKTAIDQAQNADDVNQKQADGIKAIDGQHQLGVTLNKQKATAKQAIDDEAAKVTGDIDQDVTLTAADKQAQKQAVADEAAKVKAAIDAAQNADSVIKTQTDGIRAVDDQHQAGTDLAVRKAEAQKAIDAEAVLEADAIDQDVTLTTSEKAVQKQAVTDKAAAAKDAILKAQDVDGVNQAEAAGIKGVDDVHQAGTLLDTRKAEAKKAIDAEVTQVQQAIDQDVTLIAAEKATQKQAAADEATKAKAAIDAANDADAVDQGKADGVKAVAAAHQSGALLDTRKADAKQVMDTEAAKVTAAIDRDATLTNAEKAKQKQAVTDEVTKAKAVIDAAKDADAVDQSQNDGIQHINAQYQPGIALHVRKTDAKQAIDAQAVKIADEIDQDATLTAAAKKTQKQAATDEAVKARAAIDAAQSADAVDQAKTDGLKNIADQHQPGKALTNRRDDAKQAIAKEVAKTVTAIDQDVTLTKAEKDNQKQAVTAAADKARQAIDGAQSADAVDQAKADGNKAIAGQHQAGTALATRKDDAKQAIDTEAAKVAGDIDQDNTLTAAEKQAQKQGVADEAAKAKAIVDGAQDADEVEQAQVDGIRAVDDQHQSGTDLATRQTEAQKAIDAEAALETDAIDQDVTLTSGEKAKQKQTVADKAAAGKAAIAQAQDIDGVNQATFDGVKAIDAVHQSGTLLDTRKDAAKQAIDAEAGKVEQAIDQDVTLTTDQKATQKQAVVDEAAKAKNNIDSALNADAVDQAEVDGIKAIDDQHHAGTDLATRKTAAEKAIDAEAIKVINAIERDVTLTSTKKAMQKRAVKDKEAKEKKAIGAATDADKVNNAKTHGIKHIDEQHQADATLKAHKQVAEKAIDAEAAKVIQTIDQDVTLTGAEKASQKQSVAEEVIKAKKKIQQAKDVDQINQAIAQGIKAIDDQHRSGKDLTTRKEAHKTAIDAEAAKVTASIDQDATLTGTQKAVQKQAVAAEAAKAKKTIDAATDADAVDQAKTAGIQAIDGQHQPGTAVATRKDEAKKTIDDHVAQIIDSINRDVTLTAAEKAKQKQAATDAAAKVKVVIDQAQDADGVDQAVNQNLKTIDATHQAGNALATRKDDAKAAVDAEAVKVTQAIDQDVTLTIAEKTAQRQAVANETTKAKAAIDAAQDADSVDQTKDAGIQAIGAQHVSGQAMDRSKADNKKAIDDEAVKVQHEIDQDATLTAAAKKQQKAAVVAEAVKAKQAIDDALNIEAVTNAKTEGIKTIDAQHQSGAAITLRKAEAKKAIDVEAANVTTAIDQDATLTGAQKTAQKQAVAAQADKAKQAIDVARNADGVDQAKTDGIKAIDAQHQSDAAFATRKAEAKQAIDAKAADVTAAIEQDATLTDAQKTAQKQAVAVQAEKAKQAIDAAGHADAVDQAKTDGIKAIDAQHQSGAAVMVRKAEAKQAIDAEATNVIVAIDQDATLTDAQKTTQKQAVAAQADKAKQAIDAAGDADGVDRAKADGIKAIDAQHQSAIAIATRQTEAKQAIDAEAAKVMAQIDSDNLLSDAQKTAQKQAVTTQATKAKQAIDAAGSADLVEQAKDNGIKAIDAQYQAGKAAPTVKAKSKAKPATSQDHFPKTGEQQSLLMVILGGLLSLGSSLFFTRKKRSH

SEQ ID NO: 7584 - protein, 496 aa, Lactobacillus casei
MEELLENSLLKHYYIISFLLNKDWTTIDRLAQEIKIPARTIRQDIGNINQYIAPAKIESSQRFGIRLTYDASHNPLYIYAAIYRQSTRFLILEELFLHRFSSMTQLAEELFISESTLKRHILAINQVLEHEGFRIDTQTLDIVGNEKKIHFFYYCYFLERYWFIDAFLSQDELQLIDEIIADFSAHFPVLKSPRYQSFSFLNKLRTTVFICLTRNSRGHTFKDASLVKENDTFSPELRQKITRIYRINCSSFVFSHLFYLFFNSRNALTYQDLLVKARHNPVIHSIYQALSHFLDVTAASQKLKLANRDLVLLRLYNAIEYTWGPTKILYNPDEAFFMNMNKFEQTFIKQTKETLIAILRAEKIWKQIDEALITRLLFILVTSWDNLTIQLEEKAPKVRTGLFFNTSFEHSQFLLQELSYHMRSSLKPELMHVNTLAKLKAAAPHFDMIITNLPLLNLPKCHIVSIQPHPTPEDFDNILAVYNKIISAKTVKMPAS

SEQ ID NO: 7585 - protein, 277 aa, Lactobacillus casei
MIKVAISVDNHFDVNHVDGFEMLKYQADYLVENGYQIYVNAGDTYNDFTKTLAYYRTLQQEVGQQVTVRFLAGNHDMVKGATYDEIQSDVDPLYLHEKVLPIPSTNAVIIGNNGWYDYSLGQLGKTKTDAAYAQWKRAFWIDSAIDSPLSDGERMQRVLQTTQAAIDANRGRQMIYVTHFVPIRGAMVYAVDRPSWQMATALMGSAKLGELLTGQVDAVAFGHEHFRDAPKLLGKTAYYHQPLGYGLKRLFEWESHDWLTEWRNTLVTLHVPSLAKS

SEQ ID NO: 7586 - protein, 479 aa, Lactobacillus casei
MGHPRGLLTLSMTEFWERFSYYGMRAILIYYMYYSVEKRGLGFDQPTALSIMSIYGSLVYLSATIGGFISDRLLGSRRTVFWGGVLIMLGHIVLSIPIGAVGLFGSIVLIVLGTGLLKPNVSEMVGSLYPEEDLRRDSGFSIFVMGINFGSLIAPIFVPWMADKVNFHAGFSLAAIGMFIGLIFYVVDGRKYINPADNTAPDPLKPEDVRPLVTRIVGAVVVVGVILAIMAAFKALTIANVISLITVIAIGLPVWYFILMIRSKKVTKTERSRVIAYIPLFLAAMIFWAIEEQGSVVLALFAAQQTKLDFGFFKILPGNFQTLNPLFILLYGPLFAWLWMKLGKRQPTSPKKFYLGLIFAGASYLWMVIPVMLFGSSAKVSPLWLVMSWAIVEIGEMLISPVGLSVTTKLAPKAYSSQMMSMWFLADASAQAVNAQIVRFYTPSHEVAYFAIVGLVSVAFAIILAFYTPRIEKLMQGVN

SEQ ID NO: 7587 - protein, 772 aa, Lactobacillus casei
LLELKHIKKYYQTGDYTTKALDDVSVQFREQEFVAILGPSGSGKTTLLNVIGGLDRYDSGDLLLHGRSTQNFKESDWDAYRNNSVGFIFQSYNLIMHLSILENVELGLTLSGVSAKERRKKAEAALVKVGLKEHMSKQPNQLSGGQMQRVAIARAIVSEPSILLADEPTGALDTETSQEIMKLIADLSRERLVIMVTHNPQLAHDYAQRIIEFKDGKILSDSRPYDAEEQGSHFDLRRTKMSYLTALKLSFTNIMTKKGRTFLTAFASSIGIIGIAVVLALSSGFQKQIDNTQAETLAQFPITISTNATNLTAGAQDNTKTSTFKTTKTVLAKQSASDKAQHTNKLNQKYIDYVNGISKRLTDNIGYTYGTGMNLLRDVNGKVKPVQFSTAKPTNNQSQRGFSSASSSVYPVDREGGTSYLKKNYEVVAGSYPKKDSDVILIVDRDNSTNINALKNLGFSVKNGQKLKFSDIVGTKLKAIANDHYYQNVGGSVYVPTKNYADAYQQSGNRELTVTGVLRTRSKTSDGLLSQGFAYSDRLTKDLVAMNKDSAVVKAQRNSDVNIFTNQEIDDATKDQLITSLGGSETPTQITIYPTSFKDKDKILSYLDKFNHGKKKADQVIYTDLAGTISSMTGGIMSAITIVLIAFAGISLVTSMIMIAILTYTSVLERTKEIGVLKALGARRKDVTRVFDAETIILGVSSGVLGIIIAWLLTFPINVILYNMTQLPNVAQLNPIHAVILILISTILTVLGGHIPARMAANKDAAIALRAD

SEQ ID NO: 7588 - protein, 124 aa, Lactobacillus casei
LAVWRMMFARPQFKHRQIKQMVDELSREGNFGGMPIHHIRLTRQTKELIYVDLDFELTSGLTQPLFEQMAKYILVSVAGLAHAPQRIYLMAMANPFSKLNITYYIYPDHSLDLIYWRPLLSVPS

SEQ ID NO: 7589 - protein, 140 aa, Lactobacillus casei
MYATSNAPSYVEVINQNLERLLVFETVFKEYVHTCKNIEKGNCYASESLDRLRVYFTKNVIKFCSFVDSVDAEAAPCNYAAFHRVLVNGLRGIRSGVLDILQAIGPDQIDHERFDAGLAEQQAARAQIDSAFSKILDPIF

SEQ ID NO: 7590 - protein, 476 aa, Lactobacillus casei
LKDYPKNYPLDPRTFFGINTMGLISTTAYYLYTAVLMMFITDYSGIYTGIPGKAAAVATTLLFVGRLWDAVNDLWTGYVIDISPRTRWGKFKPYVLAGTFFAGILGMMLFHIPQGISDFGKEVYLYVVYFLFMLAYTIIVTVPLTSTMSADQEIRSKLISWPRITSNVVGVVFAFFMAIATFFGTKKSPNIPLTVDVIVIPFLIIALIGGFMVKEGPVAEGTKPPKLRDIGRMVKINKPFRVNLYFTFVGGFVWALLTATSLYYIKYAFGVANLGIQSMYFGLLTLVTLVGGTFISQKAMKYMSALRGIQLCYLGMAPFLLLMFAINEFQVIHNPWLFYILIGIVMTFAGAQFVPANLIIMETMDYNRLKLNSGMEATINAVNMFLQKLQSGLATIGVGAALLLVGYNAQTLEKAAQVPDSLLQSLGVVLFGLPAIFSFVAYLLTKQYPLQGEARTKMYAELAAKTAAAQKKAAQS

SEQ ID NO: 7591 - protein, 105 aa, Lactobacillus casei
MAIHFVVYEKPHCEACRLTRRWLLTHHQRFRTTNRRGETNLVDPNSDDPLKRAWSAQKVVKFRQDGYDRFPIVRVRDDETGDVLATWNGFHPEALASWAAINRLG

SEQ ID NO: 7592 - protein, 552 aa, Lactobacillus casei
MTTKQQFPIRDVTAASGYFSPLKATVETAFHGTNVRPVTTLTEAYELAKAAPGVIITDLPIQHASDLGLPEDARILVANDGLVVGRTAAARRIIGQPGVDADTMAKVAREAVFQGGRKRFLSGRVAVGLSPDFSVEAHMMLPEAYANNLYSYLLNFQIMTAEAEKHYAQSRPLPEDDLYLYADPDWYDPAYPDGLAIFDSLHNAAIILGLRYFGELKKGTLTLAWATAHRNGFVACHGGMKQYQRQDGTFTMAAFGLSGSGKSTITLTSHGDRYPVKVLHDDAFVIDRQTGATTALEPAYFDKTQDYPLSDPGIRYFLTVQNVGVTLDDHGRKTLVTEDIRNGNGRTVKSRFVTPNRVDHLTQSIDAVFWIMKDDTLPPVVRIENPDLAAAFGATLATKRSTAENVGAHVDRDQLVIEPFANPFRCYPLAEDYQDFYELFQERGTTCYILNTGFYRGKKVKPADTLDAIAAIVDGTAQFQPFGPLPDMSYLVLPAFKVDFTAPDYRALLRKRLEARLAFLATKETADGGYDKLPEAATHALEKILTVLSESN

SEQ ID NO: 7593 - protein, 56 aa, Lactobacillus casei
MATWLIGSVVVLAIVFVLYRTFFRKNKAGGCSQCEDVGCPLIDQAKMVQANKRRKA

SEQ ID NO: 7594 - protein, 705 aa, Lactobacillus casei
MTMDETLALVGNPNSGKTTLFNALTGAKQHIGNWPGVTVERKSSRLKANSAVVIEDLPGTYSLSPYSSEEIVTRDFLLEKQPDLVINVVDATNLERNLYLTLQVMETGRPLIVALNMMDVLEKARRRTINLKKLSYALQVPVIGTTATKPAALKELVQAIQAPLPKPYAFPEYDPRLESALSMLEEVIGERVPTDRLRWYAIKLFEKDPQIAQQLAFTPAEQQQVTEILHTAEHLFDDASDSIIVNARYDFIARVMAMCVVDKEDFVMSVSDRIDRIVTDRYLALPIFVLVMWVVYYLSIQTVGTIGSDYLNDTVFGGWLPAVVGGALKSWAVAPWLSGLIVNGLIGGIGSVLGFLPQIMMLFLCLGILEDCGYMARIAFVMDRLFHRFNLSGKSFIPILIATGCGVPGIMATRTIESEKDRRMSIMLTTFMPCSAKLTVIALVSGTFFPNNSWVAPSAYFMGIIAVVCSGIFLKKTALFAGPPAPFVMELPAYHLPRVTNLYRSVMSRARAFVHKAGTIIFLSCVLLWFLSNFDFTLHMVQQNKSMLRGIGGVIAPIFAPLGFGDWHTTVATLAGLIAKENCVSTLHISFGGTGSFGQALRATYPAMAGYAFLMFNLLCAPCFAAIGTMYKEFGNARWTWRAVGYQTGVAYLLTMLIYQGSLIVSGQANVLSFGLVALAVTLIIYGLWLKRPHPVVASDYSTDI

SEQ ID NO: 7595 - protein, 163 aa, Lactobacillus casei
MQALLDIKQPGAYLLMSVGGSPALRRHLAEMGLVAGKKLTVVKLASKVTGLVVFFQGQRLAISDEIAALLVVRPFAADAERPAIPLAHLPLKQTGLVQKIQGDPPLRHRLMDMGLTKGTLVKIHQIAPLGDPIELAVRGYKLSIRKQDAAHVLVTEVTADDHG

SEQ ID NO: 7596 - protein, 252 aa, Lactobacillus casei
MHRQKTSSKAGLIWTIVILAVILVAGGLWFGLNRQAQAKAQEASSVSRSKVRSVAQSRSAAKASQAVEASQKAADPVYKDFAADGLSYHQVQAAKQLSVTAVGDSVMLGSEYLYRELFPKIYFDATVSRQIYQVPALFKSLAASGKLANTVIIGLGTNGTFTNEAFQSIMTSIGDQRQVYWINVRSDAKWTDEVNRDLGKMAKRYKNLHIVDWHGASAGHDDWLTADKTHPSTDGQTHYVATVAKAVLAKAQ

SEQ ID NO: 7597 - protein, 257 aa, Lactobacillus casei
LKSDSRFIRYYNVVIALLAVISIVMVILDYSSVISLVAFPYDVVDNAILAIFTVDYFARLLTADNKFKFFKTHLLDLLAIIPFNAIFSFFRFARAFRIVRLSRAFRITRLAGIISILQGRTRKFLHKGGLIYYLWLSVILVIIAAAIYSLAEGASYSDSIWWAIVTATTVGYGDISPNTLLGRVAAVLLMFNGIGLIGALTSSITAYLADSNNTVSTQIDDLVKLKKLLDSGGLSQEEYAQLKHHILANVSQHDTDD

SEQ ID NO: 7598 - protein, 212 aa, Lactobacillus casei
MKIAIIGATGNAGSAIYKEALKRGHEVTGYVRHPDKGIGVLPPDAELVQQDAFTLTHDQLLGYDAVVDAFATTVEQAYLHIDLADHLIHELRETTSPRLVFILGAGSLETDGKLLYDLLKNDPHAPAFINTPKNQLREYQLLQWTDNVNWIGISPSMNFEHGPATEYVRGDNTLLKDDKGKSVLNSGTLAVALLDELEKPTIKQARFTARNA

SEQ ID NO: 7599 - protein, 162 aa, Lactobacillus casei
LAQVTLTIHYVDEDGKTLGPDNHLMNTPEHHFRLTAPTLIGYDFQKAVLPDGQHVGDPTVTGTMTGDDPQLTFIYTTASSLVHHPVPATLVIQYFDNHKRPLRDAQVLHTKTGHQYELTAPDFPNFRYHHAMLPGGMIMSDKTVSGRLIQPHNELTFMYEPK

SEQ ID NO: 7600 - protein, 173 aa, Lactobacillus casei
MNNRIQLRQQKKPRHRGLKIFAVVAGILVLLLVACVFFFPQINNTIRNVTGNDTPADAAVKSRLVSGITAQKTGNAATDAALQRAADTLKETKMSTIMKAAQDQDQAAVLLQKATGANQAQAKLAAALLFQEKSITPVRQAIASGDYYRAYQDVKSLQQQGNTSTLQNLLTGQ

SEQ ID NO: 7601 - protein, 427 aa, Lactobacillus casei
MLDLKLIRQKPEWAKKKLAARAIKGEEIDELLALDEKRRKVTVQTEELKAQRNEVSGKIAVMKRNKENADDQIAAMREVGQKISALDKELAALNDKVTYILVRLPNFPADDVPMSLNEDDSREEYKWGKIPSFDFKPKHHWDIGESLGILDFERAAKVSGSRFVYYKGAGARLERAVYNFFLDEHQKEGYEEIIPPYLVNNDSMFGTGQFPKFTDATYTITNDGEPLTMIPTAEVPLVNYYRGDIIDADKLPINFTALTPAFRSEAGSAGRDTRGLIRMHQFNKVEMVKFCKPEDSWKELTNLIHDAEDLLRKLGLPYHVITLASNDASFTSAKTNDLEVWLPAQDRYREISSCSNCTDFQARRAQIRYRDDEGKLQFVHTLNGSGLAVGRTVAAILENYQQEDGTVKIPDVLVPYMHGQTVIKQED

SEQ ID NO: 7602 - protein, 525 aa, Lactobacillus casei
MKDNHDIFLSMSDAEKLGLFRTIIEVREAQTPVTAKLAAYRGHRPLVSEVNLKQIAALTNRNYGSVYNTYNGLISSLQAMLGRHHSSVKTLFAVPPDEFRYHLVAQSHPYKFLDAVLYQRYENLDDFLKACDSSKATVLRHLKALRGYARQSGVQFSYETLSFTGPELNIRLFMTIAYWLATNGVAWPFENLTHQQAGQILDGLLVVFDSGKVNTITRELLMYYVAISHQRILSGHILVHDSQSEVLHYPVPNLFSDAASRLLDKSKQFEHLTTQQQQSESDALYFLFNFAPLYIITDEQVEKRMIERYNNYNPEIYQLISGFFEHFPYSFKRDIHLPDDTYRLLFVNMLSVTVSVLAFNKDFTTSLLAEFSSNIQQTKDDPAFYQQVKVTLDEVIGRKKLSSFRNCREVLTEAFYRSLHQLVVQFQPRKKVLVAPIIEQTMTGYIDLLAFLHAVPFVELASPDANLKDVDLVITTSVGLIQDNVGKTQIFPWHINVTNDHYGQLYSLLRELWDEKMLKEARFIY

SEQ ID NO: 7603 - protein, 477 aa, Lactobacillus casei
MLYEQTFLDRADFQKYQMFSAIKDSNVQTYTINTLSRHLDLSYQQGYNILQELFRDLTELTAHPENLKRKQINLLMEIDVTVDDYHLYLLKHAIAFQFVDYIVQANHPSTEQFCRAHFISRSTLVRKTVALRALLERFQIKLSFSDLCFIGEESRIRLFLFDFYWLGYHGVDWPFKVLDEKQIVKEYMALPNAKTNPVDILEEILFWAICRVRISGNHFVTGNEPFDRIFKDYPPFQHSVYTQEMFPAFNKQFMKAENDFFYFQQHRTITFLPDTPADKDFIHYVLKQKTITADFVKRLLAFLGDHIRHHTVFDLQHEQGLILNLTRIALNNEILGGDFMHLVDFFNPRALNYTKTNLYQGLEEFIATLPDTPAYRHFLGQQHLFLRTLYYLLTPYLRYFAETPTVRVRLAYLDHNLLNRRLVNFLSDLPMVHLLPERAVFKTADLVITSVDNEQAIKAAAPAGFHGHIILDSRRQR

SEQ ID NO: 7604 - protein, 486 aa, Lactobacillus casei
VAKSATNQVKRELKTRHLSMIALGGSIGTGLFVASGSAIATAGPGGAIAAYIGIGLMVFFLMTSLGEMATYVPVSGSFSEYASRFVDPAFGFALGWNYWFNWAITVAVDVSTTAIVMHFWLPDVPGWLFSLGFLALIFTINIISVKSFGETEYWLSLIKVITVLVFLVVGLLTILGIMGGHGPIGFKNYTTGAAPFVGGLPATLAVFVVAGFSFQGTELIGITAGESATPETSIPKAIKQVFWRILLFYILSIAVIAAIIPYTSPNLLGASVDQVAISPFTLVFDRIGLAGAASVMNAVILTSVLSSANSGMYASTRMLWAMGGSGFAPRVFQKTNTRGIPIAALLLTTLVGGLTFLTSIMGPHVYQLLVAASGLTGFLAWLGIAVSHFRFRRAFVKQGHDVHELKYHAKWFPVGPILAIIMSLIVIVGQDLQAVQHFAWGRLLISYMSIPLFIVLFVWYKVKHKTKLIPLEKVDLSPHREHQATK

SEQ ID NO: 7605 - protein, 236 aa, Lactobacillus casei
LETDRLYQHGTLAMLVPGLFAGTQTIEALLQHGDTGIGTLTGLDGELIIQAGKVYQVNAQGTVREVAADEKVPFANVHYQDDVSAGKLQGLDLTGFQKAVLDRLQTSNLFAAVRVEGTFTQMHTRAVLPQQPPYPTLTETASGQKEFHADNVKGTLIGYFSPDLYAGAVSPGFHLHFLSADHHMGGHILGFELDSGELFLQKFSDFQLHLPTDDEPFLKQHFDTASLVDDIRKAEN

SEQ ID NO: 7606 - protein, 558 aa, Lactobacillus casei
MAEEKRYGADLIVESLANHGIDYVFGIPGAKIDRVFETLEHPKSEKSPQLIVARHEQNAAFMAAGIGRLTGKPGVVLTTSGPGASNLATGLVTATAEGDPVLALSGQVKRADLLRSSHQSMRNADLFAPITKYAAEVQDPDNVSEIIANAYQAAESGKQGASFVSIPQDVTDSPVNSEPIKPLVAPKLGPASPSDMTYLAHAIKEASLPVLLLGMRASSSDVTEEIRELLSVTELPVVETFQGAGIISHRQIDNFFGRVGLFRNQPGDMLLQHSDLVIAIGYDPVEYEPRNWNADGKSRIIVIDDVPAEIDHNFQPETELIGDISQTLDILVPLLRGYQVAPESKQYLTELQAKLQESDVPPALSDQKVLHPLSIVAALQKRVTDDMTVAVDVGSHYIWMARHFRSYEPRHLLFSNGMQTLGVALPWAIAATLVRPGKKAVSVSGDGGFLFSGQELETAVRLKADLVHIIWNDGHYDMVKFQEEMKYGRAAGVDFGPVDFVKYAEAFGAKGLRVNKPSELGKVLDEAFATKGPVLVDIPVDYSDNAELGAAMLPDQIY

SEQ ID NO: 7607 - protein, 184 aa, Lactobacillus casei
MTVQTEYQQAYKKRLAAIEADPQFTVLSSMNQPQDPAQKKVSQYIVFTDFKSDEQKQKTNSIYVYTPFENVDKYGHSKADYQAQLLFETNRWDNVMHITVLETLGSESRLAFYDFENLGLAQLALKAFLNLAMKADIGLVDGTISSFDKVNLAKLRHIFTKFGFNMKMTDPKTGIGKISRSMQS

SEQ ID NO: 7608 - protein, 190 aa, Lactobacillus casei
GNATFAMILYPRTEINMLQGPRVTVRPFVLADTDDYFAYARLKQVTMAAGMTPLLTREAAANHVQRFAREQQDLALVYQMHVIGNIGVYPRALSPETGDDMTREIGYILNPDFWHQGLMREGLQLVIADQFAHGIKAIWAGVFPGNHASIHLLKRLGFIFQFEVPLPRGLTEHQPRDEQYFRLLPKQFEK

SEQ ID NO: 7609 - protein, 343 aa, Lactobacillus casei
MKKLVRNILLLFIFMAFIWPLRIVNAAVAPKFTVTPILPANQRQTVTGYFDLEVQPGQQEDLQLRIANQTDETQTYTLAANPAYTTNSGMIAFDQSRPSLDQNAIRLNTLIKGPTSATIAAGSNQVVTYHLQSPTTHFIGIISGGFYVLQKGGTAATSSTGGVRFTDQFAIGIPIILRQDLKTPNPPLLELTKASIGTANHYPVVNANIYNPSSNQFGEIATDYTLFPTGGNKAVLTGHFAGLAVAPHSRFTQSIPLNGKQLQAGSYTLKWTAKSGSYTWSKQVNFRYNGHLPSNAIVSRPQTPAASQNSLTLPWIIAGIATGLLIIILGIWRWTVVRHKQNQ

SEQ ID NO: 7610 - protein, 54 aa, Lactobacillus casei
MVSASQPGYQARNQNPDSFAKSPAINSTADAFLALPCFNYAAVNTTGLKQSLKP

SEQ ID NO: 7611 - protein, 191 aa, Lactobacillus casei
MSNNRMLGNEFQTAYEDAGGTDILKFLADVKQAYRCISDLTARITAMPDSVKTESVPQLLVQQLDQTTFAESSVRKWEDDLRRFAAYLTPLEPPIAILDSWDTLTDFLEANQALLSSLQNVPLLHQDTQDVKTATQLLVYPAEPLFQVVQADTGESDAIDLPGLTAADPDGVAEIAKTHGVTPLAAFTVQP

SEQ ID NO: 7612 - protein, 49 aa, Lactobacillus casei; identical to SEQ ID NO: 1028

SEQ ID NO: 7613 - protein, 286 aa, Lactobacillus casei
MRYTFDSKATATTTVKRLLAKQGVSHRLFKKMLSDRLLWVDGQAVGNIAINAGQVVRFAIPTTKTVTPEKVPLHVLYEDDNWLIVAKPANVTSVPGPHAPNHSLLNRIVWYLQQQGITEPQPAIITRLDRDTVGLVLAAKHPYAQGRFDQAQHATLEKQYVAVVSGQLTKSEGEIDAPIGLGADGIHRIIADAGQPAQTRYKVLKMATNTLVDVQLLTGRTHQIRVHFASLGHPLIGDRLYGQPSTLIDHQALQATRLSFVDPFSKKQIHAALPIPSLFETLLNEK

SEQ ID NO: 7614 - protein, 269 aa, Lactobacillus casei
MQVEKDVIYDEAHNLPADIYVPEDANGAAIVYAQGGGWFRGDKKNEDDLGEYFANAGYLVAIPNFRLAPKFLYPTAQNDFDHFVDWLLASPYDFDRKRLGLLGASSGGTMVLQNSLSSGYPVVAWSPVVDFANWVQKNQMVKASVDAKSEFGLTEIHEIHDAFYKYFIQTYLGGLDPRLLTAVNPTNHLTDQLGPTLLFNSADELMPLPSALHFVQQAAMFGRDISLHVVPGTGHARDYTSFALPETKGFLDDHLFTSVEDKTLNKATD

SEQ ID NO: 7615 - protein, 187 aa, Lactobacillus casei
MKKWMMIAAALVTLGGLSGAAFYQHQVSAKSEVRTADAGTASTKTATHQSLTSQTSAQASTSESKSETSVTTSVKTDVATTTASTSTDAVNSSSAIAFSATSQPTVKAPFYIGTWHNEHVTLTITGDQMTITQAGVNTTSGYTAAQQGNGVILTPTDVAADPIYLVPVNGGLQWVAPGATTPLILRP

SEQ ID NO: 7616 - protein, 132 aa, Lactobacillus casei
MTYEDKIGEQKFAALVDDFFANRYIDRGMRKWQGYYLSDHTAALKKQAKAESITYPPLSLQEQPYIRMILLRAYAEGQSVTLQLDLQTPNGQMLPPITGKVAGLSDSDVVNVDGQNISIDMIRHIDLIPFPV

SEQ ID NO: 7617 - protein, 283 aa, Lactobacillus casei
LNEQRIAQAAVNSLHAEVLLAPKPGLVDPESNGAHRDMDVTTFEASIDALAPYFTQYLHAGLAAKTVPQLYQELRTIGMDAESAMLTATHGVNTHRGANFSFGFLLGALGWLLQQNSLHDLAAAEFAPLFPAVAQVAQGVAGDFRHLGDKAQLSHGEALYVKHGVTGVRGEALAGYPTIREHMLPYLRQTTTQGDLRYLRLMVHLMAQVEDANLLHRGGPAGLRFVQDAAKTLLHVSDTQLPNALRTLNAEMITLNLSPGGTADYLSLAYFFDALTLLGTKPA

SEQ ID NO: 7618 - protein, 256 aa, Lactobacillus casei
MGQAVNRLVNGFFWYNGPQDEGERTMNEVVPAVKKNLDLSQNRPIKEAVYEALRKTILLGEIPSGERINEKNLSENLNISRTPIRYALERLDEEDLVERKTGIGVVVKGISINDAYEIFDIRKELDVLAIRKAMRLMTPDQFKQMRALLEETDRLNDAGRVSEVMAKFTEFNNFIYDASHMLRLKMIVNQLQNYLIYFRDISINGDDRRNLAIQEHWLLYRGMLNRDDDQIKLITREHLEHSLQYILKVMKAKHIE

SEQ ID NO: 7619 - protein, 467 aa, Lactobacillus casei
MAKQKVQFMETVLRDGQQSLIATRMPLSDILPILGKMDAAGYHSLEMWGGATFDACLRYLNEDPWERLRKIRQVVKHTKLQMLLRGQNLLGYKNYADDVVTDFVTKSVENGIDIIRIFDALNDTRNLKTALEATKNAGGHAQLAISYTTSEFHTVDYFIKLAKKMADMGADSIAIKDMAGILTPQKAFDLVTGIKQEITVPLEVHTHATAGMAEMTYLESVRAGADIIDTAVSPFAGGTSQPATESMLVALQDLGYPTDVKLDTVSDIASYFAPIRDRFRDAGQLNPRVKDVEPKSLIYQVPGGMLSNLLAQLKDQGQESLYGDVLKEVPRVRADLGYPPLVTPLSQMVGTQSLMNVMSGERYKLIPKEIKDYVRGLYGRPPVPISPEITKKIIGDASIVTTRPADLIEPQMPGFRKAIAQYAHSEEDVLSYALFPDQAKDFLGRREDPFYDVPVQTVDLTFDPTHN

SEQ ID NO: 7620 - protein, 186 aa, Lactobacillus casei
MWSTMFKLSVLDGPQVDLGQMLAAKDARIVKEREWLTAHPETVLLHVTLRIPGPVKTGQRVVAVFSAAMQALEDQLGEAVQESQIETLATGPEAYLAVQLSPITLKRLMVGFEQQQRFCDLLDLDVVTLKNGQLHQISRADLDLPPRACLVCGGDAKACARSRRHGLPEVQQVVEAIIKEGWTTHG

SEQ ID NO: 7621 - protein, 510 aa, Lactobacillus casei
MVKNKLNREIPAPYADQYGVYGGEFANIQPYDEHARHIKPVKPDHSKLVASIHDAIVATGLKDGMTISFHHHFREGDYVMNMVMAEIAKMGIKNLSIAPSSIANVHEPLIEHIKNGVVTNITSSGLRDKVGAAISSGIMENPVVIRSHGGRARAIARGDIHIDVAFLGAPSSDEYGNINGTKGKATCGSLGYAMIDAKYADQVVAITDSLVPYPNTPISIPQTDVDYVVQVDSIGDPTGIAKGATRFTKNPKELKIAEYAAEVITKSAYFKNGFSFQTGTGGSSLAVARFLREAMLKQDIKASFALGGITNSMVELLKEGLVEKIIDVQDFDHPSAVSLGENADHYEIDANMYASPLSKGAVINQLDIAILSALEIDTDFNVNVITGSDGIIRGASGGHSDTSAACKMSMVIAPLVRGRIPTIVESVNTVVTPGASVDVVVTEVGVAINPARTDLIEMFKHLKVPQFSIEALKEMAYKITGTPEPIKYGDKVVALIEYRDGTLIDVVHNV

SEQ ID NO: 7622 - protein, 292 aa, Lactobacillus casei
MDKLRRTMMFVPGANPGMLRDAPIYGADAIMFDLEDAVSLKEKDTARMLVYSALKTFDYSSVETVVRVNALDAGGDQDIEAMVLGGINVIRLPKTETAQDIRDVDAVITAVEEKYGIEVGTTHMMAAIESAEGVLNAREIAQASSRMIGIALGAEDYLTSQHTHRSADGAELSFARNYILHAAREAGISAIDTVYTQVDNEEGLRHETELIKQLGFDGKSVINPRQIPVINSVFAPALAEVQKAREIVAGLKEAEAKGAGVVSVNGQMVDKPVVERAQYTIALAKASGMEVD

SEQ ID NO: 7623 - protein, 101 aa, Lactobacillus casei
MKINHPATAGTLESSDIQITLAPADSGTTIQLQSSVEKQFGEQIRAVIAATLTKLGIEGVAVEANDKGALDCTIKARTIAAAYRAADNKTFDWEEINAWIN

SEQ ID NO: 7624 - protein, 334 aa, Lactobacillus casei
MARLKRIWFDLNPQAAEAWQTLLVDAGLTPDRQVDYTVGIFEGDDLLATGSLSGNIIKEVAISPTAQHENLLAQIIQALLDRLDDEAITHSFVYTKPSTLKFFQSLGFKQLAATDSVVLLERGYPNFADYTKLLEESRQSGKPVAAIVMNANPVTRGHAYLIEQAAKNNAVVYVFVLSAERSMFTATERLALVKKVAARWSNVVVLPTQDYMVSSTTFPSYFLKDRADAAIATAQAGLDAALFKQRIAPILGITRRYVGEEPLSPVTAIYNQQLAATFADDIELIVVPRLTIGGSVVSATRVRAAIKHHDWATVEQLVYPEVYTEIKERSTHEN

SEQ ID NO: 7625 - protein, 47 aa, Lactobacillus casei
MKFDPTAVEQAGELMLVGMGGVFIVLFIIYIVAKLLLKFAPAKKAAK

SEQ ID NO: 7626 - protein, 374 aa, Lactobacillus casei
MEALIHGITTITLGQIAMMLIGALLMYLGIKKEYEPTLLVPMGLGAILVNFPGTGVLTQVVGGTKTEGVLDVLFKAGINTELFPLLIFIGIGAMIDFGPLLQNPFMLLFGAAAQFGIFATVFVAVFFGFNIKEAASIGIIGAADGPTSIFVSNQLAPNLLGAITVAAYSYMALVPIIQPMAIKAVTTKHERRIRMTYRAEGVSKTTKILFPIIITIIAGFIAPISLPLVGFLMFGNLLRECGVLDRLSNTAQNELVNIVSILLGLTISVKLQADQFLNIQTLMIIAFGLFAFIMDSVGGVLFAKLLNLFRKEKINPMIGAAGISAFPMSSRVIQKMATDEDPQNFVLMYAVGANVSGQIGSVIAGGLLLSFFGA

SEQ ID NO: 7627 - protein, 135 aa, Lactobacillus casei
MLRKFKITIDGKTYLVEMEEIGGTPAAPAAPAAPAAPAASSAPTPAAPTPEPAPAPAAPAAPSGEGEVVTAPMPGTVTKILVKTGDAVTENQPLMILEAMKMENEIVAPKAGTVGEIIATLNQNVNSGDGLISII

SEQ ID NO: 7628 - protein, 109 aa, Lactobacillus casei
MFKWLHRRKQPQTPVESAPVKSVNADEAAQVHEWEEVPNYLEVDPTNELTASLIAAAVTADAAPDAKLVLKHLYVENPEAKRVGLIASAIAAGDGHGHYVVKSIKKKVD

SEQ ID NO: 7629 - protein, 449 aa, Lactobacillus casei
MLLTVIAYAMIIVFMYVIMTKKLSPFTSLVMIPLLFAIIAMVAGVAKKGTIGDFVLKGLTTTANTGIMLLFAILYFSIMLDAGLFDPITARMIKIAKGDPMKVLMATAIVAMAVSLNGDGTTTTLICCSAFIPIYKKLNMNMMNLGVLIILQNTIMNLLPWGGPTARAMAVLKVDADILTYLLPGMILALAYVVFYVAPHMGRAERKRLGVRELTDEEIDEMTSVVDPEVSEIRRPNMFAFNGILTIVLIAWLVASSFIKAIAMPPLLLFLVGTCIALMANYPKLGDQSKRIGANGGDAVQVVILVFAAGVFMGLFQGTGMAEALAKSFTAIIPSSMAGFWGLVIALISAPGTFFLSNDGFYFGVMPVLATAGRAYGFTNMQMALASLMGQAFHLLSPLVAFIYLLLRLTGLDMGKWQREAGKYALGVFAIFVVTVMLFGHVPFYLPQK

SEQ ID NO: 7630 - protein, 85 aa, Lactobacillus casei
MKADAPDDLRLNPKQFANLVVGSHQVPDDKDPEAIVKRKLTLYLTAYYLAERFNELQQETLDHAPSRENFHQLLKKLEDERFQDW

SEQ ID NO: 7631 - protein, 185 aa, Lactobacillus casei
MGKRLVRISKTLSLILRHHPEKIGIILDRYGRTNLETLIRRFNAHYQMHLDRQVLDDIMTQSDKQRFAIEGSTIRAVYGHSVPVLPLMPARRPPIWLYHGTSHQAAALIDIEGLKPMDRDFVHLSENPKMAWQVGVRHDPHPVIYRVAAQSAAAAGEIFYPTGSQVWLVHAVPPAFLTRTTSPTS

SEQ ID NO: 7632 - protein, 184 aa, Lactobacillus casei
GNATFAMILYPRTEINLKLHFSTANLTDLDAIMRIEQAGFTPQEAASRSSMAARIIHYPDTFIVARTDQKIAGYIVGPAISQSTITDDLFVTSQPNSPAAPYIAILSLAVAPALQHHGIGRQLLAKMSDVARKQNRIAITLTCLQRLIPFYEHAGFHNDGQAASTHAGEVWFNMTKVVTPVSDS

SEQ ID NO: 7633 - protein, 114 aa, Lactobacillus casei
MARDDNSQMLKGILQGCLLILLARKEQYGYAISESLNLFGFENVPKGTIYPLLMTMEKKGLLTSHMRPSPDGPSRKYYAITADGEKARQTFILQWHDLKSHVDQIIANQPRLVV

SEQ ID NO: 7634 - protein, 281 aa, Lactobacillus casei
MNKRTEAVNKIAAENNQLRKQLTKANRDYYEDLLVYMRGKNLFRDDYQLEESLLGILQDLIDAQNDGTDAMTYFGHDPKQTATELLKTIPLRIGNFIWFNLKLAAMMMFILWLPRLTYPNVTFDAGSLLLASGIAIVSAWGALWYVGSHAFAKPSRLQLTAIIILGAILFGIMVSVLLFLKTSWQIRLSAHTSFTVIISGLIIAAVLPFIHHLTELERPIYYFSLFILILGLLVYLRATRSFFRTKIDFGKWQWLFYVFIILLGVGIGVLIWWLGERRHRH

SEQ ID NO: 7635 - protein, 256 aa, Lactobacillus casei
NADPHLTQNETIRRQLHHRSIRQFKPEHLSHQTIQTLLDVAQHTASSMYLQLFSVIHILDPKIRAKIAAMSTQTYLNGPGELFIFIADLHRVADLTKAAQQPLDRLGRMDKFLQASADATLALQNMVVAAESLGLGTVTLGSIQNDAQALIDLLHLPKYTFPLLGLAIGFPDEHPDEKPRMPESLVAFTNHYGEPAPAADAMAAYNRTVHDYYATRHGNPREETYTDLAVSAATHTPAKRDDLFKVMRRQGFFPES

SEQ ID NO: 7636 - protein, 305 aa, Lactobacillus casei
MATNVIELDHVQKKFGKFEALKNVSFTLSSGQVLGFLGPNGAGKSTTIRIILGMLKKTAGSVTVFGHDAWRDDAVIHPRIAYIPGDVYLWPNLSGGEIIDLLLRLNGRDHNQKTDDLMQRFKFDPTKKARTYSKGNRQKVVLIAALSQDADLYIFDEPTSGLDPLNEQTFQQEVLKLKQAGKSVLLSSHILSEVERMCDSIVIIRDGSVIESGNLDQMQHLARLKVEVTTTTANDDLARVAGVHDLTFAAADHTKAVFTADRDELSRIMQTLATTSILDLRVSPPTLEDLFMRYYGKPGEPHAAE

SEQ ID NO: 7637 - protein, 538 aa, Lactobacillus casei
MRRNNRHAGYLLKANLKQNLKFSVVWLVILIMMILSGAVKLEAAFVNGASGSKDIVKMLQAPGMAAMFGATPKVITYNAAIIFASVMVVSMIILQALWVMPLMIRDTRGQEESGLLEMVRARDVGRPADVVAAIWELLLVSFVLAAAYFASLLAVNMDGTDMTGDLLFAIAMLIANLVFGSMALLFAQLANNTRTASMLSYMVLAAAYLIRLVTDLNHQQLTWLSPIGWFEKVDFYTKNQLMPLYLGLACSILLCGAAIAIAQNRDLGAGVLAEGKGRATAAPWLRSMPALIWRTERGLLSGWLIGAVIFGGVMGSVLGGVGDILKTNPIYRQLLDVKQIHAANQTMVLSFLAMYMAIFVALAVTAGGQIAFRLKHDDRLGYLGIIHAEKPTRTTISTSYNCWALLVGISVFSVGLLALFLTGNAVLDQPLPVKYLGRLFIGGLPAVLAFITLGIALAGLWPKLSSLFWLYMGAGLIVQVFHGLFSLPKHAGDFTPFGWIADVPIKALGQSWLAIMLVSAVILFIIGVVGYRRQDLSV

SEQ ID NO: 7638 - protein, 210 aa, Lactobacillus casei
MKKVVTDPQKVTRILQAATDAFGQLGFAKTKTDQIAATAGVSKGLIFHYFGNKQALYLDTFKTAYQRIYAHMDPHHWQDAPGLAAMMSAAVKYEMKLQLAFPAEYRLMMQAYADLPHFPQPLQQQIQQETQAISVEANRIFREKIEQLPRRQGISVDDIFSVVSALIAQQTAVTTQLIATGKYRNFEDLQAVVDQMNRQLKIVEHGFLPD

SEQ ID NO: 7639 - protein, 467 aa, Lactobacillus casei
MAKTTIEQKEKNARHALFVITIVALMSFFGVLTETSMNVTFPTLMHDFHVSLTTVQWVTSGYLLAAALVMLSSAYMKRRFTNRQLFITAALLFIIGDLMCALAPVFWVLLLGRLVQAGCVGLCGPLMVNIILDTVPTSKLGTYMGIANLIILIGPALGPTFGGAIANFFDWRMIFWSTLPFATLLLVLGQGRIKQYTPTSAFAFDWLRFATLGVALISLTLALNGISEHTWLIAGVAGAVVLVAMGAFLWLSKHHAKALFKLDVFHDGGFLYSFLPYILMQFSNVGINFLLPNYVQTVDGASAFVGGLILLPGSVFNGLGQPVYGWMLDHFGGRLPLLLGNSLFTVGMLGFTIWGRHIGVLGVTILYLIFAIGRSMAFGNSTAYGLKVMAHQYQSDANALYSTGQQVTGSIGTTVLAGMMTAVTVPGLTHAQNVGIGSQLAFALLLLIGLVNFGFYVRLFKLTKAKA

SEQ ID NO: 7640 - protein, 245 aa, Lactobacillus casei
MTIVLILLGFLVGAFIMTMGGGGGAFYLGIMTGVAHLSPSTAAATSLFTAIPALAVGCYSHYRTGNMRFHAGNKILLTAVPATIVGSLAAPYIPELIYSWAIAIIFVVLGVQMLRQSFARHAKKTGQPTWFAYVLGIISGLMVGIAGLSGGGPIMAGLMLMGLDMPHAAATSSYALVALSIIGCLLHATQGTIAWTVGGLLMLGSLVGAAITPRILNRFDPRLLTAILRPVLGVLLIVMAVNQVW

SEQ ID NO: 7641 - protein, 342 aa, Lactobacillus casei
MQLSQIIRNKRLAAGLTQEELAQKVGVSAPAVSKWEKGTSYPDITLLPVLARNLGTDINTLLDFSSDLDPVALQDFNAKLTMTAQKDGWQAAVALIDQELRDYPSVSQLQMMAAPFLDMLKPQIPKDDWPPVQQRIIKLYKAAEQSSDLQQAQLAALGLFNFYLSEEQFDAAEKQLAALPTETVTAWALKPKLQLKRGQLAEAYVEGEKLLANDYGALGQVLSLLSQVAIADHQLATAEEYVTLAKALDQAIHVNSPFVFGDELQLAKATKDIKRAVAVIRQYADNLGQPFPKVFQHLPQPKPRESLAAARKQFVQDIALDPDLAFLQDTPEYNELLKQYVD

SEQ ID NO: 7642 - protein, 146 aa, Lactobacillus casei
MKIIEVKDRQPVLIQQLLAVWRQSVRATHSFLSDEELKSIEEYVPQALRQVAHLIIAEEDGVPVAFMGTENEMLEMLFVASAKRGEGLGKRLVQFGIENDGIKRLAVNEQNPQAKGFYEHLGFQVYNRTDYDEQGNPYPLLYMQLD

SEQ ID NO: 7643 - protein, 285 aa, Lactobacillus casei
MTKKWGKVMLIIGIFLVVSGGAWWWVNRGEAPSTKRVAGTYQTPTLFVHGFGGGYGSEKDMINDLSKHPGYRQVLRYTVTNTGQLSVSGSWSPSVRHPLIAVVFSSGRPDAATLTKILKQLKKRYGIQDFNAVGHSAGSAAWADWAVTKDKKGEPTLQRLITIAGPFNGFPGMPGMNSGQDIKLASDGRPSVMSDRYKPMYENRRNFPKTAAVLNLFGNLGKGSDGRVPVNSARSLRYIVAGRAKSYSEREITNSKAQHSKLHEHNPLVNRYLYEFLSTGKITDP

SEQ ID NO: 7644 - protein, 126 aa, Lactobacillus casei
VEFDDKVPIYLQIKQYLYQAIITDRLKSGAQLPAVRQLAAELTVNVNTVQRALSELIQEGVLVTRRGRGNFVTDDIKVLIELKNRVIATELGTLYRQLADLNLSAAEMKDAFAQYVDEQEAHHDHE

SEQ ID NO: 7645 - protein, 238 aa, Lactobacillus casei
MTTNKISAEHLTYKRNRQLILDDLNLEVQQGHFIGLLGANGAGKTTLMRLLNGVATNFTGTIQIGASESIVDRKQLSSFSESLKGVNAHRTLHQIATDYAIMYLDFSEKAFENFTNKYELDCHQKLSALSKGNRKKFATALTLSRQTQLYLLDEPFEGIDSMTRKRLISNMIAWKPAAATVMISDHHVNDVVNILDEIVVLKDKHVVAHRNTEQLREETGMSVEAYYESLYEGSTTND

SEQ ID NO: 7646 - protein, 237 aa, Lactobacillus casei
MTNTWTMTKVLIRQRIQTVVNTLVVTIVATIITAILMYFGGSARFSIELFYYAFQPYLIIGGLYLFIRLAIRQEHTWVDNYYRSVPITNLKLYLANLFSTICNFVIYCLAQSLIFTILQVASHGIHWPETSVWMDVAEGVIILGLTCLFIWTFVSLVHLLSVTIMAFLPETQIRLAQWAIYLVVIITASYLFNQLWQLFLMPFSNYNITAILGVFLVIFALISSLNVYLLDKWVETK

SEQ ID NO: 7647 - protein, 292 aa, Lactobacillus casei
LTEPLFAIQDLSVNFRKDQRLIKAVNHINFTIASGTTVGLVGESGSGKTTTGRAIAGIGPISGGDVLFSGESIQHFSHAERKQFRRQVQMVFQDPFASLNPRQKVADIIAEGIDNFHLASSTQERLDRVLQLLEQVGLPPDAINRFPHEFSGGQRQRIGIARALAVEPKFLVLDEPISALDVSIQAQIVNLLRQIQQAQHLTYLFIAHDLSMVHYISDQIVVMYQGQIVETGATEAVYRHPLHPYTQTLLASVPQADPLFEQQKPRVHFDRTPIPAGAALTEAAPDHWVLAL

SEQ ID NO: 7648 - protein, 355 aa, Lactobacillus casei
MTDIVSIKNLTVTFHEANENVYAVNGVDLTLHQGETLALVGESGSGKSVTTHALLGLLGKDAEVKADAMQYGETDLLHASKKAYTRLRGQELGLIFQDSLSGLNPTMRIGRQIGEGVKAHRHLHGAVLKQAVNAAIQDVGLPDPALIARKYPHELSGGQRQRAMIAMAMIMQPKVLIADEPTTALDVTLQAQVLDLIKRQKAKRDLSVIFITHDLGVVANIADRVAIMYAGKIVETGTANEIFYNPQHPYTWGLLDAVPSSDDQRKELFTLPGTPPDLRKPIKGDPFAPRNPYALAIDFKEMPPLFQVSPTHFVRSWLLDPRTPSYQPPVTIQKRWARFAELTKEPSLAVAVNQA

SEQ ID NO: 7649 - protein, 102 aa, Lactobacillus casei
MIQKHPWQVGAALFIGLLVVTTGLSLTREGLTLAILWGLHQTFWLLVGLAILAVGIKLLLHTRRPHANLTSKMLRALPGNLQLGIWVAVNLIGGTVIDLLLY

SEQ ID NO: 7650 - protein, 318 aa, Lactobacillus casei
MAVSDTDFHFVQGTDNAGMPTVLTKQPTISVDEANAPKSISFWASARQKLLKDHLAVAWGIILILIVLVALIGPQLQHYDPNLIRVNARNVGPSAAHWFGTDRLGRDLFTRTCIGIQVSLLVAILSTVLAIGFGTIYGMVMAFFGGWVDEIMMRIIEVFNSLPGLLITMLIMVVLGNGMWTMLFALALTSWSDAARQARGLVMQLRQLDYVTAAVMLDTPVWRIMTRHLVPNMMSILILDIGQSIPGNIFGEASLSFLGLGIQAPNTSLGILIASGQDQMLQHPLQLYIPIMVLVAIVFAFNIVGDGLRDALDPKFQG

SEQ ID NO: 7651 - protein, 316 aa, Lactobacillus casei
VIKLIVRRFIELLISTFLIATATFFLISAVPGDALSAQTDKLPAATRAQVYKNTGLNKPVMERYVITMNNMLHGQFGESIADPSVTMSNLIRDRLPASARLGIQQMLLGIPLGLLLGILAAVYKNTWIDRVVTILALFLMSFPSLVLGLLLQSYFGGKLGWFPIIGWPSGDQLWWGGWIYTILPTIAGGVGYIAGYARLLKNSMVDVASSEYVMTARAKGLSEPQIVLHHIVRNAFIPIITSLPVTLAFGITGSIFIESIFVIPGIGQYFVTALTNRDVPIIMGETVLLAILYIVTMFITDLLYTVVDPRIKLYDN

SEQ ID NO: 7652 - protein, 556 aa, Lactobacillus casei
MKKSHWLTALITGVALATLLVGCGSKGSASSSSAQTLNLTEELDPTTLDVNDMRNTNENDILSEVQEGLTTIESKNGKDKVVLTGAKSYTKSADGLTYTFKLRDAKWSDGKKVTAQQYVDSFRRLLKKENAFSQATNAYFIKGAEAYNTGKGSAEDLGVKALNAKTLQVQLAYAYPSLLSDFASVTYYPVRLDKINKVGNKKWKTDVKDQVFNGPFKLTSWKKNDKITLKKNNTYWNAKKVKLQTITYTTTNKPSTVLSLMQSGQLDALSASGKQISDFNKLAKSNKLVSRKQDGSGTTVLIMNQHNGGTQGLFKNTKVREAVSLSINRQSYNKAVNDGKDQPTYTMVPQSVNVGSTNYGEYVGNPLKDLQAQYNTKAKRQALLKEGLKELGKSTDLSKLNFVYLTVDDDDTGTWLKQELDQQLGVKVTIKTAPDVPSFVKSRNDNQYDLLDNGWSGSADPNSYLSLWDSNNGFQQFFGGYNSKTFDDLDAKLNANLSTKERLALYKQLETQLVAKDFGVVPLTNSESRIYINKSVKNLQSTVFGATFNYTYASKE

SEQ ID NO: 7653 - protein, 87 aa, Lactobacillus casei
MFNWLILGHIIFGLISFVGSLLLALGFRASFASLTPIQKWGIGLSIGGLFATMAFAMLSAANGVSALLFIGAGAALLWVLMHHRAEA

SEQ ID NO: 7654 - protein, 552 aa, Lactobacillus casei
MTKLKQIWQLVGTRIAPLLWLIALICAGFEFALARIIQNVTQQSMLTIRLFVVALGAALMIGLGRWLIGRWQTQAQYRLVQRLQTQQMAALMTGPVATDDQTGSERLNGMTTEASLAAPLFIQSVTALAVGTFSFLAASLFGWLSSWLLMVVIVGLCLTALLIPRFMAGRLTQAQDTQQVENGRMQSALLEVLAGRTLLRDYQSEQFGLQLFRKAYQTFADSQYHMGIQQTGTIVLGFALGLFVDIAILGVELWFVGFKMITVGQFAAFAMLTPSFTWLFYSMPGQYAQLSRQVVAAKRLLALVTLPEQKHSDLTQKVSGQYTSASSFSGEQLVLQDLSYTYPSAHQPVLQQLNLTIDVAAHEKILVTGPSGGGKSTLIQIILGLLIPQAGMIQGQPAGVASERLADKIGFVPQVVALFDDTLLQNITLGRPVTQAAIEAVLAQTDLQAFVDRLPQGLTTQLHGQAKANVSAGELQKIGLARALVAKRAMLLLDEPFANLDAASAKALSQGLKSLPIAMMVISHRLDITRFWDRALRLENGRLNEESLAKPK

SEQ ID NO: 7655 - protein, 534 aa, Lactobacillus casei
MQTIFQIGSIKKRWLVGLLGLRVAVDGFNVAISMLIQLGLTAALAGQVGLLLGIFGGMLGASVVYTGVYWLSGVVVERLKRRLSLAIATALVSSFLAGKADEAPDSGLAMNLMVTDTQNIMQFLDTGVLPLVDFGITVILGIAYVATQSWQLAVVFILIGLGFAVVSRQLFRYQNRAQTNLIGIDDRHKGFFNDFLANFAMVRNLHVFSYIQQRHQVFFQEATPSLMQLASAAGTLSGIFNGGIYLAEVLTLVLGFTLLPLTQQSVASVLGAWNAGVGSILWPFLGLAPTIAYLAQQKTSLQRILPRLQVASEVPITTNTKIAVTHDQPMTIVGERVTFHYPNSSRQLLHNLNFQIDNHGITFIIGANGAGKTTLMKLILGELLPTSGHIDIRGRPTATSPSELVAFVPQRSVMFTASVAANLLLVEDHSSQRVMPLLHQLGLEKYADDVDQILHPAQLSPGEQRRFGIARALLSGRPWLVLDEPFSDIDTVNQAMVMQILRQEARRRGIIVITHTFDFVTAADHIIKVGEQHD

SEQ ID NO: 7656 - protein, 132 aa, Lactobacillus casei
MASIKLSQSFVDLMKKKHFDQKVLLLIADDGGGRYSLQGGACSIGTKFTLIVLDQPDPDYQVKLDNDAGLKLYTSDYDMIFFASGLAMDFKNGAISIKDDAHAYLDGSVRIAKGSDVLAAFKKGILMSGATC

SEQ ID NO: 7657 - protein, 55 aa, Lactobacillus casei
MAEADNEKRIENAVNSHTDADTETVNVRMINATQHVPIQELHSLQEFEDLYRDED

SEQ ID NO: 7658 - protein, 281 aa, Lactobacillus casei
MSDLDRIVNAYDLGQIKRVAPMTNGKSGRAWRVETDASTVLVKTVADTARASLEFALTQAIQEEDRDVTPAILSTTEGHPFVMVDHQVYRVQNYWQQAATKPSLAATLACYRKIRVALDRFEYAWSTDDSQSLDRLWESQRASLAQNWPGIYEQLTPMITQLETIDRQQGTWVHGDLGRWNLLSLANEKVAIIDFGEARRGPRFLDFAALFDSFMPREKNAVKVYKDRFCDLAGIEEQDQHIFLATVQLWLVKGMLVAVEKAPEHVQNFWDRVQLVGNLSS

SEQ ID NO: 7659 - protein, 251 aa, Lactobacillus casei
MKHRNRLFWVIVLVAGVFLIYSTESPLPIATRETVKNGIAQVWNTATRTVSGWLNDNNQANQASQASSGSLIASNTSQSATSTSTSADTTPALNIVQGRHLRKTYFYHFDANLPQSEHNVFNEAVRAYNATGIVKLIPGKGQKNDNQITFSSYQKGMSEQDLGATELGEGGPTIIVETMGTQVTVINHARASLNLTYPAQSINEAVAMHELGHALGLDHSKSLDSVMYPITRGVTQLSSGDIAGLKAIYGP

SEQ ID NO: 7660 - protein, 1158 aa, Lactobacillus casei
MGRQQRFLAAVGDRAHKVTLVHSKHHGWLAVGLTAFALGVTGVGLSNQGQVVHASEQQPSAQQTQTNNVRVWKLRPVSEIEAQLKASGNTVYDIQWGDTLSTISEAMNNSGYTTSVERLAAINRIANVDLIYAGAKLALQGNGANATVTTQNAAGTNQTFNLNPAKPAIASGAQQSETRYTVVGGSNGSSPTGTTNLADSGQSGNTTTTPNSTGNGETPTDDAAAKKALEEAAAAKAKAEAEKAAAEKAKAEAEAKLTALLNEENNQTLTSLQSKRTAAQTAVDAAKAKVDATQNKLKNAQAAAKQAQAAFDQANAAVTAKQNEVDQANSAVKDLTDQITSLQTQLNTLAGQVKNDPTSQAQVVDVKAKLAVAQEKITVYEGQLADAKSALTQAQQAASQANQNLTTANQNLTAVDNEAKAAQNEFNQAQTTLQSLPTSVTSADSQAANTVKQHLADLNTKLDQLNQTIAGLNEKIAAWQQQLATAQTNVDTANANIAKTKDQTAKVDATDHNGTLAEGQKTVAEVQKTVPTIHVPHDTEKNVTINQDESGQTITNLDGYKLVKTGTPVKSVQTLANGDTITTYTTMNTYHKVVHTTVNKTVNVDEAGHTLTNVDGYTQVSISKQVADDTDPKTGDVTTTVTVTTVWRKTNATPTHQTVNKTVNVDEKGNVLTDTTGYTQVSISRQVADDTDPNTGEVTTTVTTTIVWRKTNTAPTHQTVNKTVNVDEKGNVLTDTTGYTQVSSSKSSSDTTDPTTGNVTTTITTTVVWKKNETTPTHFIRNVMVNVDETGKVLTNTDNYEQVSRSVQVSEDTDPKSGNVTTTYTITIVWEKSTDPGMTITNSFVNKDDEGNVLTSTDGYRLIGSSTSTSTLTLGNWTRKMVTVTYVYHKPRAKTVNKEVDVDEGGYTLTNTTGYTKVSSTPTSVTTTDPNNGDTVTTITTTNVWRNVAAAGTIIGKIKSVNDAVTTLIQDQVKVKDERVSVEQGQEYTDNDLTMAVAKKFNVLVNGEQARTGHVQTTLTTYQKAYETVAQRAVEVMYKFAHVRPTNPAPSGTQAVSYADGEGYMQLNTENISTSSILKSDVDGNADKLSTLIANAMFKQYIIDERPENNNGQTGGHYQNIINSNYKNIVIGIYVTDNGFYYAASSTVATGDDSVYRG

SEQ ID NO: 7661 - protein, 110 aa, Lactobacillus casei
LPLQERVAKRIHELRLSKAMTQEQLAEKANMDVSMLARIERGSRGDIRMGTLDRIINGLGVTYQEFFTFGDDENQATRLASSIALIQDPDILTALQKIVDSIINPSGKHS

SEQ ID NO: 7662 - protein, 450 aa, Lactobacillus casei
MTEHDSYRKFLARIPRVMLYDDSLNRVDLLRRILKQLGSPDMTFPTIHICGTNGKGSTSTMIAQILQNEGYRVGLFTSPSLLDEREDIQYNRRMIAEDEFLAAYEVLIQGMAGMNLTQADISFFETWYLVAIIFFAQKRVDYAVIECGLGGELDATNATSNVKFAVFTKIALDHMKILGNTIEAIATAKSKIIKSDSMIVIDYPAQASVAHDIIAKRAEEQHAKLWVDQNFEINLVSSDLTSNLIDVRLNDHWHRALKFSLAGKYQINNLATVLKWCSAFNASEPCKIKDDSIVAMINSVAFPGRMEELSSKPTLVIDGAHNVNGIDALVKTLLAAVPNRKLTVLVGFLCDKQVALCVDRLLDLPHATFVVSTPDNPERAMSSDELYRIFDENDKMRQDHEVYNAPNASAAVDYISANADDEMVYIAVGSFYFINQVKMRWDSRGARTVL

SEQ ID NO: 7663 - protein, 190 aa, Lactobacillus casei
MKPFDRALIETSVRNILIAIGDDPDREGLKETPARVASAYEEMFSSLHQKAFTESKVFNSSLANDGELVVVADIPFYSMCEHHLLPFFGSVSVGYMPKNGRIIGLSKIPRLVDYVAKKPNVQENLTSQIGLELQKLVDPQGVAVVVKARHMCTEMRGIKKANSHTLTSFFSGAFKNKDNRMEFLQEIKNQ

SEQ ID NO: 7664 - protein, 165 aa, Lactobacillus casei
MSAGLKHTAFIGLGSNLGDSLQTVGAAVDVIDADPQIEVTGRSSWYDTSPVGYEAQANFVNGVIKIETSYTPLELLDALNQIEKRFKRERTIHWGPRTLDLDIELYDEETIRTSRLEIPHHEMFNRLFVLEPLEEVYDGNAETARRIHDAITKIQGTQQIRKIEN

SEQ ID NO: 7665 - protein, 121 aa, Lactobacillus casei
MTVVIRLNSAKFHAHIGVYPEERTIGQDIAISAEITLKLTDLAILKADELANTISYGEVYKIIAHEVSLSQDKLLETLGVRIVEALQARFADKFSSLTLSIKKIALPINGIVDNAEVCITI

SEQ ID NO: 7666 - protein, 277 aa, Lactobacillus casei
MKPDYFTANSFKLPLDGTTKVMGIVNVTPDSFYDGGKYESTELAVEHALSLVAQGADMIDIGGQTTKPGSQPISAETELARILPVISALKGKLDVPISVDTYKPQVVEGVIKAGVDVINLIFQDEASEKVILDMLADTSMGLVLAHSSFPRMLDPDRALEQLKDFFNAQQQLLQGYGIGAERVLFDPALGYAYGLDLAGNLKVINESKTLSDDFPMLYGYSQKQFIGDLTENIAPGRLAGTQAITAHLASQGVDFVRVHEVAEAKQLLTMLNQIWRA

SEQ ID NO: 7667 - protein, 217 aa, Lactobacillus casei
MKKSMIGVATLLFALGLSGCGSQQKTSQKTSTPSKTQVSSSKASASSASKQPSASSQKAAKSSQSVSSSSEQPVWSSAKGQQLAAFISEWEKTMGQQYESYWQGNSADMYGLKIPDELSQPDGTNGKMAMAVGDKAVTWALSANGQSNAEYTIVAIYSNAAHARYGGKYVYLFTLHNGQPEVLVTGQNQGNENNWIYFGETRNEALREGFAKIVKGD

SEQ ID NO: 7668 - protein, 227 aa, Lactobacillus casei
MIRDKFQIAPDQNRRFARANFVKLVHTDARFEGVTTTLSQTQTIMDGLGVNGVPIDDINVIVQLKRGWQYITTDDHPLTLEVERHINKIVALHDSLDPGHFRTGNSTVQISSKEDFVPPDVDVAAEEKWLADLLNDAAMSDTERALRLLYHNMRGQLFWDGNKRTAMLTVNKLMIDHGVGLINVPLDKWPDWNNLISQYYRSGDMAEILAWTYTNGIQGVNLSITTD

SEQ ID NO: 7669 - protein, 269 aa, Lactobacillus casei
VSTLISLINSMADSKMVKQIPKRIHIPVIYAWFLILLVISTQTSFLNSLKIQKYFPKNICNAFISLIDSFYQICGNPWVFFSFFVFSLGLINFASSKWAYELKSTETAYGEWRAYSAIAAIKRLTRFVIWIAGSLWIIKFSIKLLMQSETSVGAFAFNNFLTGDTFFFWGNVCVLAWYCLRALFLSEGTNTFRYNTSEELEANFISINHKSVSSVNFFLAKGKFSHSKDFYLFEEIKNSSSKRQTVTRKYKIIDSDKNFSVIRYHFDHL

SEQ ID NO: 7670 - protein, 168 aa, Lactobacillus casei
VSKTELSVSTRHLFGRLNEESQDLEAAIDHHWDIYGTFPERVLVDKIYRTMANRAYCKERDIEMPGSKPGRPPKHLDPAKKKAMIEAENRCGAIERRISHLKFQDGLSLVRAKRIESIAVTIDFALVDANLDLLLDLLGDPFLICVRDGRQTINVLYQMMGSEAKLAG

SEQ ID NO: 7671 - protein, 85 aa, Lactobacillus casei
MAQIAFDVPWLVLDDGPAMLALLLEMTRVVVPFFLRNPLVGAWWRDFQLFPHIVDQGFKIEADLIEQVGVLRKLDVNRNCGRIND

SEQ ID NO: 7672 - protein, 440 aa, Lactobacillus casei
LNKDAGYDWREVKIVHPFLYADLVEQITEEEHWKELLARFDLFESNPKIKCISLPVKSTGKKGDTAETILNWWEELEQTSIVKSLEYTYCIRTDITNCYGSIYTHTIDWAIRGKDVAKKATTKRKDRSFAHMLDWTVEKLQCNQTNGIPQGGELFNFIAEIVLGYSDLLLSEELKDINDLDWLVVRYRDDYRIFSNSKEVAEKIVKTIADILSGLNMHFNIKKTGLVTDIIESAIKPDKVYWNSRVPIIMPKVWDGKYCRINYQLTLQKHLLEILWLSKKFPNSGSVSKALTSFAKRLDQQKSIDKSIMPLVSIIAEIISKNPKSIASGVGVLSKLLLKGHTELSKSADIVSKITKKLENTPNLEYLDVWLQRLSLLSGSEPTLSGKMCNAVRDHDYSIWDSSFIRTKVNLPSIIDETKIQALKPEISTEIFDVFSDYDA

SEQ ID NO: 7673 - protein, 124 aa, Lactobacillus casei
LAGNVLHSLPKFPPRLGRLKVELAGIFLTNFMILIRGKINENELMAVMTKMSSERKSVLEMTAAEARAFFLKSSSYVNIVLPEYFDFQPVLDFAFSKVSGSRLKSMIDLQILKTSENAITTPLY

SEQ ID NO: 7674 - protein, 517 aa, Lactobacillus casei
VANDQNKDYDKIIVLDYGSQYNQLITRRIREFGIYSELKPHTITAAEVKEIAPKGIIFSGGPNSVYDKGALGVDEDIFKLGIPILGVCYGMQLMAQRLGGDVEPADNREYGKADIEVTDDRAKLFRDLPKDQTVWMSHGDLVTRVPDGFRSTATSVNCPISAMDDDERKFYGIQFHAEVQNTQYGHEILHHFAFDVCHAEANWSMDDFITKQIAKIRAEVGDKRVLLGLSGGVDSSVVGVLLHKAIGKQLTSIFVDHGLLRKGEAEQVMDSLKGKFGLNIIKVDAKDRFLNDLKGVTDPEKKRKIIGRDFIEVFNEEAAKLNGIEFLAQGTLYTDVVESGTDTAQTIKSHHNVGGLPKDLKFKLIEPLNKLFKDEVRELGEKLGMPHALVWRQPFPGPGLGIRVIGEVTEDKLEIVRDSDYILREEIAKHGLDKDIWQYFTVLPGFRSVGVMGDGRTYDYTIGIRAITSIDGMTADFARIDWDVLQEISSRIVNEVKHVNRVVYDITSKPPATIEWE

SEQ ID NO: 7675 - protein, 308 aa, Lactobacillus casei
MQSEMNFYKFDRAEWSQFHSQNFTSVTDAELAQLRSLNDEISLDDVKTIYSPLRHLIHIRYEDYQGDMFTLSRFLGMQRNPHTPFIIGIAGSVAVGKSTTARLLQLLLSRAYPDKRVQQITTDGFLYPNAELERRGILDRKGFPESYDMQLLIHFMNNVKNASGVVRAPKYSHQIYDIVPNEYEVIDRPDILIVEGINVLQLPSKQPIYVSDYFDFSIYVDADPTLIEQWYLERFGILLDTAFTDPSNYYYQYAIGNRKDAFDMARKVWRDVNLKNLKEYILPTKNRADIILHKTTGHKIDQVALRKW

SEQ ID NO: 7676 - protein, 111 aa, Lactobacillus casei
MFESLLSLIPEVVLESIFIPIFRPEFNLEASTKFNWFRFLLTLAVSGLFAGAGIWLLLQLLTDSLNPVSLFGGLLLLASGSIPAGRAVIDFMDYRRQRLAKIEAEKPYQEL

SEQ ID NO: 7677 - protein, 469 aa, Lactobacillus casei
LAKRYVGSCTTVLVGKKASIDGSTIIARNEDGESPLHPQKFVYVKPEDQPRQYHSVLSKFSIDLPADPLGYTSTPEAEDGHGIWAAAGINSDNVAMTSTETITTNSRILGVDPLVPAGIGEEDMPTIVLPYIHSAREGVQRLGSLLQQYGTYESNGIAFADKDEVWYFESIGGHHWAAIRIPDDAYVIAPNRFNITDFDFTSDDTMSSADLRDLIETYHLNPDTEGYNLRHIFGSATIKDTRYNNPRAWYGQKYFNPEFDTTPIDQDLPFICRTSKKISIEDVKFVESSHYENTPYDVYGTTGTPAQKKLYRPIGINRNQELHILQIRNDVPAAVAGIHWLAFGPNTFNAVVPFYANVNDTPAAYRDSGDHFDVSKMYWLSNLLATFGDYDFSLFKDQEDVFEQKTVAACRHLQLQTDKAVQDAKNIREHLTTANEQMADLAMANSNELLGQMVAAAAPKMKLQFTLHD

SEQ ID NO: 7678 - protein, 158 aa, Lactobacillus casei
MVKMRDTLAVSSYRVFPGMLNAHKTLFGGQIFTWIDDVSSIAAQRLGRRGLATGSLDMVRLNAPVTLGDALIIKCMVSGVGHRSLEVFIHLIGEHLATGERFQVGTAFATFVARHKEDGPLPALEAESDFEKRLLAGYDERRADYRKINASFGEVPLD

SEQ ID NO: 7679 - protein, 763 aa, Lactobacillus casei
VVEIEQAKEQQHLDGIMKELSSAEVRLSKEMAKTKTEEKSISDNFFNDFSLNFSNDAETIETAASIQQQQRVLDERTNAWKQSAQQLATVKRLAGNPYFARIDFQEGQEKPETIYIGLGSFTNEAGKFLIYDWRAPISSIYYDGGLGKVTYQTPDGPQQVNVSLKRQFVIKNGRIQTMFDTTETIGDQMLLEVLGEKSDTQMKTIVTTIQREQNQIIRDTKADLLFVQGAAGSGKTSAVLQRVAYLLYRYRGNLTSSQVIMFSPNQLFSDYISNVLPELGEQNMVQFTYYQYVTRRLPHIDVQNLFSQFEQQLTPVQKKIARVKGSLDFFNAAKTYATSLERSGLRFRDIRFRGEVFFSRKRIREIFYSYNENYHMGNRLNATKERLIKMLNRKIESETKAQWVQEAVQNLSDETIRSMQQDGPKEFKNSDDEYRFFARQLVMKGFDEIQQDIVRNRFINIRGQYVSFLREVPAIYDLAAEGISEDEWQAEVDHFIDVFKQRQLPMADATPYLHLYDLITGRHGEREMRYVFVDEIQDYTPYQLAYLKDSFPRAKFTLLGDLNQAIFTKDDSRTLINETSKLFDPEKTRVVQLTQSYRSTKQVTDFTKAILTSGQKIVAFNRQGPLPKLVVRPDEAALMTALGAQLKVNNEAKQTTAVIAKTLEDAEAIYDQMKAAGIKVTLIKSENQRLAAGVIVVPSFLAKGLEFDAVVLWQVNAANYHEEDERELLYTVASRAMHRLTMLASPDVTPLLDKVPADLYERG

SEQ ID NO: 7680 - protein, 65 aa, Lactobacillus casei
MIQNQKPPRQGKSFFNRRAVIVGTCVLVGLLISLPFKRILLGVAIGLAVGYVLEAWTPLLRRKLK

SEQ ID NO: 7681 - protein, 609 aa, Lactobacillus casei
MESISLLIVLTAALVTPLFMAHFHINSIPTAVAEILVGIVLGKSLLGWVHTGGNVQSLSELGVTILIFLSGMEIDFSLFKPQPKTTKGPQPANPVILAAVGFATVVLLSLGFSYLLQLIHFFSYPIFATILFTTIALGVVIAALKEKELLHQPLGQTILLIAALGEVIPLISLTIYSAVNGSSDSNLWLLLLLLLAALVLLARFKRVYSFFAAIDKSTTQLDIRLAFFLVFTLVTIASQVGAESILGAFLAGMVMKLLGPRQETQDKLTSIGYGFFIPIFFIVTGANLNLKALIADPKSLSLIPLVLVGFFITKIGLYPVLRRRFKVSNALAGTFLSSATITLVIPTLTVGRNLGIVTEQQSGAFTLAAVIACVSGPILFNRLFKPEPETFKKTRVTFIGGNLLTVPIAQHLSSDRYDVQLFTDKAENFRTYNSEVAISLADYQEDALKAAGAFDCDIIVLGDFDADTNYALAKMALAQKVPRIIARFAAKDATTDRYDRLRDEGVEVFNALDANIALLRSLIETPSTLQILDDTIAGIYEVTIRNSRFAGLELKNLPFIDDITVSQIYRNKKFIAPHGDTQLYLGDHLIFSGDKHLIRNIRTQVEKLN

SEQ ID NO: 7682 - protein, 301 aa, Lactobacillus casei
MKQGTTILTLDNGYHLWTNTQGEGDIHLLCLHGGPGGTHEYWENFGEELADLGVQVHMYDQLGSFYSDQPDYSDPEIAKKYLTTDYFLGEVEEVRKKLGLDHFYLIGQSWGGALTQLYALKYGQHLKGAIISSMVDNINEYVEHINLVREEALPPSAVKYMKKIEKAGKWDDPQYQKYVDVLNRGYVDRKQPPAISHLISTMATPVYNAFQGDNEFVVTGKLKDWDISDQIHNIKVPTLLTFGEHETMPLKAAQRMAEVIPHARLVTTPNGGHHHMIDNAPVYFKHLKQFISDVENGTFND

SEQ ID NO: 7683 - protein, 153 aa, Lactobacillus casei
MAYTVDFKTVSTTGLESSPVAQSLAGLRANEARYIWNKFKVPYVTYPIAARPDSLAWLQTILAERALTFAAKPLEICDLALPDMRWVEAYYQDGLVVNVMYSLTDPKKRAVGFKLSEGMAVPDELAGKFKFARQKSKLAGTIRGSFFVIKGSY

SEQ ID NO: 7684 - protein, 450 aa, Lactobacillus casei
MKQDDRLRAQQAKRSLDDINRSVQVPGVYETSFFQKFLAYSGPGALVAVGYMDPGNWLTALEGGSKYHDALLSVLLMTILVAMFMQSLSIKLGVVARLDLAQAIAAFVPKWARICLWLINEAAMMATDMTGVVGTAIALKLLFGLPLMWGMLLTIADVLVVLFFLRFGIRRIELIVLASILTVGIIFGIEVLRAHPSVGGIVGGFVPHTEILTNHGMLVLSLGIMGATIMPHNIYLHSSLAQSRRYDEHIPAQVTEALRFGKWDSNVHLVAAFLINALLLVLGATLFYGVGGHVTAFQGVYNGLKNPAIVGGLASPIMSTLFAFALLITGLISSIASTLAGQIVMEGYLNIQMPLWERRLLTRAVTLIPIMIIGFIMGFSEHNFEQVIVYAQVALSIALPFTLFPLVALTDRSDLMGDHVNSPGVRWVGYLLTGLITLLNLQLIVSVFVP

SEQ ID NO: 7685 - protein, 322 aa, Lactobacillus casei
MATGLLIVNLGSPVSPSTRDVRRYLQEFLSDQNVITMPKMLWQPILRGFILPFRSWRSATFYQHEWTKAGSPLIAYTQVTRDRLRKKLPDWDVQMAMTYGGEYPIGETLQNMAARGDHPIVVIPLFPEYTQSTTKTILDKVAASGVKTLVIDQFYDQPAYLQLLAKQLDDAYSQDDYDTVILSYHGIPTSMVRHGDPYQQACEATTAGVKRYLKKVPQEKVEMCYQSKFGPVPWLKPYLRNRLMALAALGKRRVLVTTPSFVADCLETLEENDVQNYQTFRANGGKVFKSVRPMNGCAPFCDLLASLAKEKVAAEAQDDETR

SEQ ID NO: 7686 - protein, 221 aa, Lactobacillus casei
MATKGITVYLVRHGQTWFNHFNKMQGWCDSPLTENGVKDGTNTGIILRNVAFTHAYCSDTMRATRTADLILSKNVTGKIPLTVTPFFREQFYGYFEGEDSGQTWYMVGFPHGAKTYPEILEQYGVDASKDFMHDADPFHEAEDARTYWTRLMKGFRQLRSENKEGDKVLMVSHGTTIRSIVDKFGKNDGFVVTDSPRNGSISKILLTDTGIKILSYNEFEA

SEQ ID NO: 7687 - protein, 66 aa, Lactobacillus casei
MGLSCEIVVGGAFFAPPKTRPSFETQPGLLRLKVVLTTLASRSPAPIWTEIAEFGTARNNQASNSL

SEQ ID NO: 7688 - protein, 297 aa, Lactobacillus casei
MADSKKDFLNPEYTQAFIDSPFVQQMQKVTWNLYQHGWDERNGGNVSYRLTEQEVSQYGDVHEVKRNIPIKFDASELAGQYFLVTGTGRYFKNLKDFPERDTGLVRIAEDGHSVDLLWGFSDGGQPTSEFPAHLMTHIQRLKKDPNQRVVMHCHPTNTIAMTFTLPWKEKLFSRIFWKMQAESIVVFPEGVGVLPYMTPGTNEIGQATAEKMGTYRIVLWPLHGIFGAGDSIDETYGLIETVEKAATIYTAIQAQGGKFVNEITDENLEQLAQRFDLTPNPEFIHGDSLIKEKELVH

SEQ ID NO: 7689 - protein, 603 aa, Lactobacillus casei
MMLTKLALGGLKNRFRDYAVLFSGLVIASAVFYMFMALATNTSFLTKNSPIAFTPFIFGFGAILLAIITLVYIVYANSFLLSMRQRDYAMFMMLGAKGRKIGQLVFLETVVIGLLATVAGIAIGMVGTTFIGQWLIKTLHAPATGFSAIWVPAILWTLGFFIILFIFSAIYNAGKLLKTPMMALLHQAQTPNRIKQRKASFVIQIVLGLVLLAIGYYSMANIAVFQLMAIPIALVTIVAGTYFLFNSVFVALISLMKRNKKFAAKQLHTFTLSQLSFRIRDYTRILSVVSILFALALGAITVGLGFTHDIPMLVNQTTVYDVTVTSPNAATRAEVNKLQGVTAKHQYTLKSDAKTVYISKAAIDAHPLEIKANDKGLNAPAIKITSRNFDRVIERYPTAFGVFIGNNRGKQLKVADAATFAKLGNAQTLTTIKVKDFNQNYDTIQKIVTMQQHQYPRLGDSNTDQKIAFYDIINGMYSGLAFMGFFLGIAFLAMLASTLMFKILSGANYDQSRYLMLQKIGARPQALRRSIRQEIGALFLLPGLVGIVHVLFGLQMFKTLLSQPYANLLVPFGLFIVLYGLYYLATVWIYQSIVINKDLAAKA

SEQ ID NO: 7690 - protein, 253 aa, Lactobacillus casei
MAKQQPIVTVENVTKTYGKRGEKQTPALKGVSFEVEPGEFVGIMGASGSGKTTLLNILSTLDTPTSGSVRIKGDDVTKLKGNALSDFRAKRIGFIFQDFNLLENLTGRENIALPLALQNVSAKKQGEAVDKIAQTLGIEPVLDHYPTELSGGQKQRVAAARALVQQPDILFGDEPTGALDSTAARELLDTMAHLNQDEGVSILLVTHDPFSASYASRILFIKDGQIGSELKHGDKSQEAFYQEILETLGTFQK

SEQ ID NO: 7691 - protein, 556 aa, Lactobacillus casei
MNDLEKPQKQYIPWMVVGLMDFVTVIGFDDIIYNFQNQGLVAFTSWIIMTFFYVIPYNLIVAHMGSTFSEHGGGITSWMRETNGDTVGYYAAWFYWITGLPYVVDVANSVVISFGWITNGNGNIQANLGNAWFGILTAVIFVIFIWLQHFFKNKSLEIMSTIGGGAMFIMTILFVVMTFIGLSKGAPIATRPFDFKAFIPKDFFSLSFLSTFGLFVFAMNGSELAAPYTKDMRHPARDFPKALKMIAIMTMFLTLFGTFSLGVYFNAHHLPNDLKMNGSYYAFQAIGRQFGLGNSLMYLFAVVQGIYMLAQLAVILDASTRVFLSDVAKRFMPRQLTKMNEDGLPINGYWMTTILCALIMALGALLPKINDIFNWLLNLNGIVSPLSTCFLFWSYTMVRLHQDRFPTPDYTFLKNRKVGLVVGIWMLGITFLLGTLGFFPTDATADTFALMLVLNIVVPIGMVALGVLMPWIAKRQRNAVSGLAFSRNTWLVFTALSLVGLIAAATYGMHVNLLNHLTPVIQWAIIIAVDLAIAAVVIKVTANGRHQLLATPDDEA

SEQ ID NO: 7692 - protein, 293 aa, Lactobacillus casei
MLSYTIIYNPASGHAKGPTAAEVLKAKLEDRQRLVTMKPTKNADDAREFAARAHSDVVVAVGGDGTINQVVAGLAPRQQPPILGILPEGTVNNLAKVLHIPLLLPLAIKNILEAKPQPLDIAQVNDRYMVSTLTLGVLANAALSVTQKEKRHFGPIIYLLKGFKVLAQHQHWQLQLDTAHHQWKKDTQFLLVTMTNSVGGFTNAVPDATPDDGHLHVFIAPKLAWWRSLLAIPYFITGNFQKLPGMTYFKTEQLTIQAPKTLQSRVDGDPSAKTPLKLAVIADHIQVLAPPLK

SEQ ID NO: 7693 - protein, 431 aa, Lactobacillus casei
MTEQISNEVTSENVLIAGISRQQADFDYTMTELGELAKADNYTVVGEVRQNLDRAVAATYFGSGKVEEIRELANVRDATTVVINDELSPSQLRNLEKQTKLHVIDRTQLILDIFADRARSKAAKTQVEIAQLQYALPRLHPSANRLDQQVGGGAGFATRGSGETQLELDRRVLNKRISHLRQELKEASVGDQVRRARREDNAIPVVALVGYTNAGKSTTMNGLLQLFADRPEDKQVFEKDMLFATLDTSVRQITLPDNRKFLLSDTVGFVSKLPHNLIDSFKATLAEAANADLLIQVVDYSDENYPEMMAITEKTLKEVGIHNIPMIEAYNKADLREGTRYPEATGQRLIYSARDKRSLQALTQLIKADLFGQDEEHTYLIPFDQGQLVNYLNQETVVKATDYTEDGTRITAVVNPVQKGKLAKFAVKEEV

SEQ ID NO: 7694 - protein, 326 aa, Lactobacillus casei
MKSSFKWQWWLVVLGLTLILAGALSVKSLVDRHAAEARARQASHERAVADSISTSKAQASSRRASSSRKRRAAEQAEREQASAELPSNIGQAHIPAATAYAYPVAEVKKEMTAPYTSNIKKKVVFLTFDDGPNTVNSPQVLNILNQAGVHATFFVVGRQLSPETAPVLKAEYDAGNSIGLHSMTHNYNLLYPGRTGAASVIENEAKTEQAAVKQVLGADFETHLWRYPGGHFSWKGLAAADTGLTQLGLDWVDWNAAVGDALSPAQEPKTEDAMLQYHLRSLAVYPTSNVRVVLMHDAIGKDMTVKTLPRIIDYYRSNGYEFGILS

SEQ ID NO: 7695 - protein, 774 aa, Lactobacillus casei
VIDLDTRFNRLNVKTAMLTFYLRYKPWRFWIVFPILITRLLFWLHRLDELDYQVKYWRYFINEPLPEKKWRQFGRRLSNRSRRRVKATTFIVADVPVFMLNWLVPDSRIVGLDIDEKGLRLPKARTLSAKIAFLQPESLVVSPRFFKTFVHHTSFENITRIYANQHFFSSFKGFNRYQTVLFLRNVVALFAMATFTAVVTIYMASAAYNLDLTNVVFKSLRLILLNILPIFVFMLIGYLLFNRVTIAILVGQVLAIVVALVNYFMLQYRDYPFEYSDISLASEASNMGSRYSYIPPVKYFLVIAVLLILAVIVGRFLKTTTLRWWVRLLTLGLVFISSVFMMNHYYLVDDYYTLANNDPWGPDADRYVVNGYMFSFIHSVKNDWVIVPEGYNAATAKKALSAYQYQDIPADKRLNVITIQLEAFQDFSKWSDLEIDPSVYAGLHQVASEGMAGQLTTTIFGGGTVDTERKVLTGFSELSPINGMTNSFVQYFNEQKYVTRFMHPGDAWFYNRQNIDRYLGFQKTLFRDNYYDQHVADVDVVPDTKVFNDLVKQLKKVNASGKQFFNQTVTMQNHGPYSTEFDGDPLLPWKKGYNKDDYAIINNYLTGVKETSDALLKLTNKLDRLNQPVVLAFWGDHNPWGGDQNSTYKMLGINLKQSTQEGYENYYNTPYVMWANEAAKKIMAKDFSGTGPTISPMYVLPEIFTHAGWKGSQYMQVLQNLEGQVPVFGQKNHYMINGKLTTKPGKSQKQAIKKFEDIQYYMKSNYMMNQKQLK

SEQ ID NO: 7696 - protein, 349 aa, Lactobacillus casei
VAFYLGLFAIMIIFMLLGRVTMSSVWAWLGVIMLALVAGLRYETGNDFLPYKTIYAGDYSAGQVEPGFLLLRNIFNGLHAPFWLFLLAWATVTLVLFYFFAREYFRPAIIPIAYYMSRFFFMRDMGQIRASLVCVTCMLALKFVYDEKPLPFVLIVGLSATIHISALFFLLIYPFWLLFRKINFKWVIGFLALGAAVGFVAPKILSVIIVHTLPRYAPYVTNASYLSSGLFDPVTLMQVLICVTGFYILKRGMIADTLIGGSAKFKFLMIVYLFATLTLLSLSQLSTIGGRLSTIGTTTETIVLPTIVFSIMPKRTRTLAMVGVCGVIFVLIFLISGAYKTFIPYQMAF

SEQ ID NO: 7697 - protein, 211 aa, Lactobacillus casei
MTNELAHQFVSDTSVSSQEFRTLRNNLSLQTSRHDVSVLLITSATAGEGKSYVAANLAASFAVEGKRTLLVEGNLHRPILAAVFDLQPNKGLSSLVGADAASVKADDLIIETKIQKLTVAPAGESLADPATLLAGSAFKAFLDQVKDRFDVVLIDGPAMADASEAGLIAELANGVVVVAKADGPSKRDVAQTIAQVRQLPAALIGTVLNQA

SEQ ID NO: 7698 - protein, 230 aa, Lactobacillus casei
MDNLLSMKELMVSLRKNWWLALCTLLVGAVLAGAFAFGMMKPSYSSTALTVINQQKNNTESLSQMLNQNQYDSELLATGKSLFKTAAVFDEASTQLAQKDHLNITSGDLQKQVKVDNEDNSRAFSIHATSKHAKDAALIANEVAAAFQKTVGTITNHTDTVTILAKATPSDVAAGTKPVVLVVIGAIIGFLVGLAWIVLREIKQATIKTKETLVQVAKAPVLGVISAKKL

SEQ ID NO: 7699 - protein, 479 aa, Lactobacillus casei
LPNRFEVTRKSIVWSYAGTIFSMASNFLLLPIIFHFLNPQEIGYWYLILSINGLIALFDFGFDPAFARNIAYIWSGAKTLKSRGVDKEHDHTVVNYHLLASTIHAARAIYMILAIVAVVLVGIFGTIYMNTFVFSKLPAAEYKWTWLVFCFSLFLNLYFGYFSALLRGSGKIDSVNKAQVFSRSLQILLTLGGFLVYPSILSPVIGLVMYGIIFRTICSHFYWQDDEVRAHRKELKSPMNWHEIKEIFLFIWPNTWRDGLVSMSNYVTSQGMSLMAGAFLPLSVTGVYSVGVQFASAIGTASSAINGAYNPILQSNFVKQDFDSIREKTSKAVAAYVWLFGIASVGTLLVIFPLLKLIKPESVPTLQVFLPLILYYFLYQQHSVHASYIANANIIPYTKAFLISAGVNLVGLWLGLKLTGGNIYFLLFFPILVQGLYNNWRWPTYYYKMIDSTLLASIKRGTIAWGKTFANFFKSGSNV

SEQ ID NO: 7700 - protein, 378 aa, Lactobacillus casei
MKILFVSTGHVDDDSRLLKESAALQAAGHDVTILGWREDPHGRMTTDTFEFDGQRLKAIFTGIKLSYSFKYFKIYAFMRFEAFLYRWLRKHLREYDAVQACNVHTGYVTAKVVAKTKTKFVYDIFDYAPDTRNYPGWYRKMVVHWENVAMATADWTLICSEDRRRQIEPAKPKNLAVIYNSPLDSPIAADAEKFDPAQKNFKIVYIGGLSPYRCLPELLGAVEANPALSLTVAGQGQYQEMFADAAKRSSRIDYLGVVPYEKVNGIEKTADILVALYDPVLKNHLYASPNKFFEAMELGKPLLMVEKSGMSNWLTKYGFGAVCGTSEKSIGAGLQQLIDKRQDWAKEANLMRNIYQKEFAWPLMQQRLRHIYASFETK

SEQ ID NO: 7701 - protein, 321 aa, Lactobacillus casei
MNDQLSIIIPVFNSQNYLPRLFKSLGAIPPTVEVVLVDNGSTDNSAQLLQHFHEVHTNSLLIDEAHAGVAFARNAGLERAHGKYIWFVDADDTLQPNAINRILKVINDIDFDLLIFDYRSLTEQDTASSDDQTPKTAQKTDLAAVLHEMLTGAHDPIGGFPHNKIFARSLIGADRFPDFKSAEDMAFFVPILFRAKHIYRLRETLYDYYQHANSIVHKIRADKLIDYAKVMDLVEQRLRSNGTAPKNDVDEYILRRRLSIYFQNLAEAKDPWVKKHIRKKMKQYSWKQLLSFSHDKKLMVKILLYKFRILDVFPFLLKYFY

SEQ ID NO: 7702 - protein, 561 aa, Lactobacillus casei
MKIDSKRLIKSVTIILILSVVSLFNVLPVLKLNFATAYLGDDFFFHVERVLALSNIFQSPVNFNVFGQAATMANIFYPWETVYPLYLIYAATGDFIFSYKLFYFLLTLVTALLAYWCIYKISKNTFSALCFSALYIFSFYRISNFFVRAALGEVVSMTFLPLVLLGLYYVLFADFKKWRVLTIGMTLVTYSHALSLFMTSVLIIVATIATIGFTDDKMKRLINLVKAGFWTFLLCSPYLFLVANTSLKNDLYINWTQPLKGMSLLPWLANSLGNQMYPNPDVKSSLGASVVIALAVALVIFAFSKSVRTPFNAFCLFGGVGILLLSTSLFPWALTNQTLFSRIQFVWRLNAYTSLLILASFSMLVGMMMPKKMPALKPILLVGLAVCLTISSGSAFATFAKNKAEKTPRDPQIAKLARNIFYGDYSPKQVLDTKNLQQVLQKQYFLNHRPIQPTASYTDSIYTIKVSNTTGKDAILKAPVFWYSYQTVTVNGQPATSKMSAAGTTIVKIPSGEVTVTISYHYPKLLLGFILVALLSLFLLTMSTGPVKKVMTNAPFTKIVH

SEQ ID NO: 7703 - protein, 581 aa, Lactobacillus casei
VQEASKPGWKHDVIWIAAMMVVALIVLSPQINYHALAVGDDWEFHWNRFYEAAMQIKTGKFNFFQSIYSFKQSGRIVNAVYGSAFAYLHGIILVIVKTWFRAELISSFLCLFTAGSGMYFLARYCRIKRQIAFAAGVLYMGTPLVIFYVTDAALRGWGAALLPITTIPLIRMVTNHQKPINPILFGLSAAILMAVQNFTALIYVLSAAVFFIPGLYLAKNRWQTVVAAGSAVAVAVGLNAVTLAAIMDLHSERLVMPYRVEDLLGSASRLSLGNMTRLDLGLVLSAIIVLQLVFAGLSWKQLTIAEKLINLDGLLFLWLSSPLFPWNFLATHFPVIQTVQFPQRFNVIALTMIILGTALSVQRFVPNIVSQKLRLMTALFVSVAGLNLINGYTWVNEKATAWQSDQLAVSADSSVQNQAEIRDLFNRAYDQSNVFSVVTKNTPDYLPVATAGNTTFAYDAYKNQILNNPLNIKKAINAESQLVMTWQAKSRKQTLVPVIVYKHSTVRLNGRVLRSSQYQRSNIGALIVTSHKGKNTVTVGYQPFKLFWLAVWVNAFTVIFLLVYCGMKIKMRFSKNKSVQK

SEQ ID NO: 7704 - protein, 691 aa, Lactobacillus casei
MGKKEKKMKNKLFWASAAIASSILFSQLVLGTPVSAADEGTGANAQTSQTSQDQTVSVPAMNGHSNLDSGTASGANAATSARSFSSTQAGGAALQAALPQTNVQTFAAQTPTVMSFTIGDKSVPRTDVVDVSSWQSWMNQDSFNTLHALGVKGAVVKTSEGTFYENSSASDQIQFARNAGMTVSVYHYVHFASNAEAVSEANYFANVLDKLNVGKETNVIADLEAADIGGDVSANLNAFWQTLNQRGYTHHVVYTFKNFAYMKAAADTVGQNRTWIAQYPYTPSANSMWNQDFGAWQFSSLAYLPGASKPVDVSVDYTGLLTQPNTVAAPAPSYDPILSTKSVNYDVTIVNQDTRKDGIYFDAPYHTSASTAISNFNGVNYNNQNVHVQAETVTSRGTYLQVKAQDGKVFWIDKNGTAQFSFDSIVSQQTVDYSATIEQQGRGDGIYTAGPYHTSAATSGGNSDATKYDGQKVQVIAEATTSRAGGTTYAQVRLADGQTFWIDKRGLQTGDNSGYDKVLLKKSVNYLAIVDQSHRADGLYANGPYHTSATTAIGNDNAKSLNGQLVQVLTEATTSRSTHSTYVQIRLANGQTYWTDKLALTSFSSLSPILSTNNVNYDATINQKDRVDGLYSDGPYHTSISTLVGNDNAKQYDGQKVHASVEQKTDRGTYVKVKFADGHEYWIDKGGLTVK

SEQ ID NO: 7705 - protein, 495 aa, Lactobacillus casei
MGRRTIVLLESINALINKLGRYLLVAVFAFCLLCLFKIQILQGSAWDTPAFVLGGMGILVGVFLIFKLSQLELSDRQALLLLTVLAIVFLSFWNFIFRPVPVSDYQVLLEGAHDIVNGTFKAQAARPSDYFRYYNFQIGYAYYLSLLMRVFGERLLFFKIVEMLVMTGTTLVLYKTIRLFCDGHRAIFGAALFTFFPFAFIGVGIINNQHEGLLLEALAVYFVLKRRSWPNLLIAAVCITIAQVLRPTAVVVAIAIVVTLAIQAVQQKSRQRLLETVAFLVAFWGLGWLINQLFILSGIAPYGIKGGNPYYKFLIGLTGKGVSGKYTTSARKSQLYYDLKEYHFNYSLYKQAAAEKLRYVFTHGLDIQEIMKRFTGFIGNVDNQYNLGGNQPFLDQHPLLISSLNFSGMVIYAGTILATFKRVVTEKWLTSRISYLLPAVVFGMFFFAYIFMETQARYRFEQYYVLFLLAVPALYGWLTKIQKKMFTRDFSEELR

SEQ ID NO: 7706 - protein, 346 aa, Lactobacillus casei
LDLILLPFIGFLFASIRPSQNLEEGHLGKSATNNLKGISIIFIILHHINQELNGVSGTFFASRLTMAGRLGVAIFFFVSGYGIMRQYQIKGPSYLKNFLPHRLLPIILLYLLAMLLIFPIKHQLMGLTFSQAAISMTNGAPFVNDSWFVLAIIFFYFAFWLGMQISRGHSLPLFAILFLLTGLYTVYIWDKGMGEWLVNAAFVFPTGVLFAFYEDRFMPLIRRFYLPIMLGTLTAFALFFTLDEMHNQLRFRFFSEVFFALAVMMVSYRVEFSSKLFLISSAWSLNLYLYHPFIASWLHTIPAIGAHSVVYSIMVILLSYFVAGIIAYVQVTIKQLRSKRLASRSA

SEQ ID NO: 7707 - protein, 335 aa, Lactobacillus casei
MALPVLWIVIPCYNEEKVLPITAPRFLAKLSEFIEAKKVAATSRILFVDDGSKDQTWPLIQNFAQTDPHYLGIQQSRNRGHQNAVLAGLMVAKDHADVTISIDADGQDDLNAMADMLAAYADGCEVVYGVRSNRKSDSWFKRVSAQAFYRFLRVMGVDVVYNHADYRLASSKVLQHLADFKEVNLFLRGMFPLVGFKSTSVYYERHERLAGKSHYPLSKMIALAINGVTSLSIKPIVFIAELGAVVSILGFIGTIWAVIMAIKGATVAGWASIVCIVSFLGGIQLLSLGVIGEYVGKTYLETKHRPRFIISDQTWHDEPSKQPKADKDVEKQRKP

SEQ ID NO: 7708 - protein, 380 aa, Lactobacillus casei
LAKIKVMTVFGTRPEAIKMAPVVLGLKRRSDEFEEVTVVTGQHREMLDQVLTIFHIQPSYDLNIMKSRQTLADITSNVLLKLGQIIAKEEPDIVLVHGDTTTTFAASISAFYQQTKVGHVEAGLRTWNKYSPYPEEMNRQLTDVLSDLYFAPTAQSRANLLQEHHPDKQIFVTGNTAIDALDQTVQDDYHHEVLDLIDPNKKMILVTMHRRENQGEPMRRVFKVMRDVVESHPDIEIIYPVHLNPVVQEAADSILGHHQRIHLIEPLDVVDFHNLAARSYFIMTDSGGVQEEAPSLGKPVLVLRDTTERPEGVQAGTLKLVGTDPQTVKKAMLQLLDDQVEYQRMADAKNPYGDGHASQRILDAILYEFGKRETRPAPFK

SEQ ID NO: 7709 - protein, 293 aa, Lactobacillus casei
MKKTLLVLPVLLLVFAAGCGQSNQSSTSQKESVKTSQTSHKAKKASAKKSNGKTSASQSSAQSSSQIAASTTSQTGQKAATAASSGTTSNDQRLATLKQAVFNQIPNAKWPASYPVANSQHLNIFATGDQANYSIFFSPGQSALPYNDPTLQNINAELAIQKKTYASAADAQAQVAPARSTQGLRQVAIGDGIYAASQGAAGSSYLTWNEGRWTVTVKASTVNGEDPLPLAKQAVSWFAQNALPVPDGHGTVDLAVTNANTRQNQITWTEGNALYMISGLEPMQTIQEGTATR

SEQ ID NO: 7710 - protein, 466 aa, Lactobacillus casei
MKQSAEWNGLKRLLTMIGDVGLFNLSILLAFYWRFGAEIPEWNFKMYEGSAIYISLLFLFVNFFLGVYVYYNRRISDIIFNTVLAQTITILGLTMITFMGRFFAFPRLVLAYSFVLSILILGIWRVFIYYMYIHFTSNYKVAVLSYEHELPAVLENFHSAKNNKHKVTYVISDHFVENAKKIIDKVDIFYLTKSLPDEQRREIIDIIIKKEKTILLPSTFDNLMMLRPNLMNFEDESVMGITQFRIKPESAVLKRIFDIVVALLMLIVASPFMLITALLVKLTSPGPVIYKQTRITLNQKEFKILKFRTMSATAEAKSGPVLAKAHDSRITPVGKYLRKFRLDELPQIFNVLKGDMSIVGPRPERPYFVNQFNQQEPHYYLRHNVRAGITGYAQVYGKYASDYHSKLKFDLLYIKTYSIFLDARILLQTIKVLFDKVSSQGLEEDTEPERQKLHDLVVQQDITHLS

SEQ ID NO: 7711 - protein, 246 aa, Lactobacillus casei
MIPKIIHYAWFGSTPPSFIEDRVQEWKEKLPDWEFKFWNDKNFDLKKYAFSEKMYQAGKLGYAADELRYAVLYQYGGFYLDTDMIIKKDLEPFLNHKMVWGFQYDNSILTSFIGAEAKTPLLAEILDVYAGRKFPELQDDMQRMTSNPVVTKILMRLYPDFRMNGQRQELEPGIVVYPRDYFTYASRNQNANYMEHLFDNSWGSANVGLRGRLKHLFKVLFPYLWADISARRGIKSAERDGIPYQR

SEQ ID NO: 7712 - protein, 251 aa, Lactobacillus casei
LVKTPVVSVVMPAYNAAAYLPKTVQSVLDQTFKDFELLIIDDDSTDQTAEVGQQLAASDSRIRFVHLDDNQGVANARNVGVANAEGQYVAFLDSDDLWLPDKLKLQVAFMQQHQAAFSYCSYDVVDDHGTKIGERKISEARLDYHEMLKGNRIGLLTVMLTREIAQKYPFPKINHEDYACWLSIARGGTLAYLASDRILAQYRKHQTSLSSNKLQAAQWTWTIYRQHEHLNIFKSLYYFLHYSLMGITDKR

SEQ ID NO: 7713 - protein, 311 aa, Lactobacillus casei
LSSYLVTGGAGFIGSNLTELLLTDPDNTITIVDDLSMGLRTNIPDSSRITFYEHSITDHAFMSQLLMEGQFDYIVLLAAIASVADSVERPYATHQVNQEANLNIIETLRTQKIAYKKLFFASSAAVYGDSPELPKKEDMAVKPLTQYAVDKFATERAVLNYGRLYDMPMVCTRFFNVYGPKQNPKSPYSGVLSIMMDALKADKPFTFFGDGEQTRDFIYVGDVVHAIRGLLETPSARDDVFNVANGKQTSLNQVAKELEKLTGKTLHATHKAPRLGDIRDSYAQTAKLDQFDFMTHTPLAEGLAKYVASVQ

SEQ ID NO: 7714 - protein, 220 aa, Lactobacillus casei
MHNFIDAYSWINLRYLLQGLGVTLEVSVASIFFSFVLGVILGLARYVNIKYFSAIVGFVIDVIRNLPLLLILFFTYFALPEIGIRLNVIIAAIVAMSIFESAMLAEIVRSGINAVPRGQMEAARSNGLTFYQAMRYIIMPQALKKMIPPIVSQFISLVKDTSLATIILLPEATYHAQIIYGQNINYMIPMFVALAVMYFVVNYALSLASRWLDRRLVQSN

SEQ ID NO: 7715 - protein, 214 aa, Lactobacillus casei
MWSILTNNWNTFLSGLGYTLAASILALIGSLIIGTLFALMEISPFKALRIIGRIYVEVVRNIPLLVITLAFYVIVPQFIVKIDGFTAGTIGLLIYTSAFIAETVRAGIEAVPSGQMEGARSIGMSYTQAMTQIIFPQAFKIVIPPLGNQFINLVKNSSVLAFVAGFDLMYQGKLIAATTFSTFDTYLIVGILYLILTMPLSYLMRYLEKKWVTA

SEQ ID NO: 7716 - protein, 274 aa, Lactobacillus casei
MKKMWKRMLLPLVLLLMMIPLSSCGKSVADRDILSHAKATNTIVWGVKADTRLFGLMNIKTDKIEGFDVDMAKAVTKQILGKKGNAQLVQVTSDTRVPMLKGGNVDAVIATMTITPERQKILDFSDVYFNAGQSLLVKKGSPIKTVKDLKKGTKVIGVQGSNSVDNVKKAAPETTVLQLADYAQAFTALKSGQGDALTTDNGILYGMSEQDNRYIVTGGTFTKEPYGIAINKGQRPFVKAVNKAIKQLKQNGTYAKLIKKWFGDVPGFSLKEVE

SEQ ID NO: 7717 - protein, 245 aa, Lactobacillus casei
MSMIEFHDVNKYFGKFQALKNINLTVDRGEVVTIIGPSGSGKSTLLRCINGLERITSGQLIVNDFDLADKKTDMNRIRKNVGMVFQHFNLYANKNVLQNVTLGPDLVLKRDKAEVEQEARDLLKMVGLESKADSFPGELSGGQQQRVAIARSLAMKPKAILFDEPTSALDPEMIGDVLDVMQKIAEQGMTMVVVTHEMGFARHVGNRIVFMDDGQILVDSSDVNQFFDDPQEPRAKEFISKIINH

SEQ ID NO: 7718 - protein, 329 aa, Lactobacillus casei
MLTVIDIINRVLGYFNIADKPKGKAFTWVAFFANFYLLYVAIENLRYPDFRIRGALFLLAFVVFLYFIGLNFLYYFTNKTTRFDISPAVEKWLGSNGAKKTAVENELKTQLGAAPANGVFSQEQLLTADVTLTDDQQANLDALVASLVKQGVLSLNYQGLDDKAIERVAQETQQPVLAIGAPYPLPFFDLQHVNDQLIITGGLNALTAKPIATVERVGLLPVEKAAQDYHLVAANVFLIGGEQKLLGRSGLRKESQPYSLTVQLAYQDKSPAASQEKADTDTHPVAGRQPEAPQETREGRHALDDDATTKLEQQESQQFPTRESRRHQK

SEQ ID NO: 7719 - protein, 152 aa, Lactobacillus casei
MAYRTPPLLPPTAIVSLIVLISAYNIVNTINPVNQPKSATDQSSLVSKIKSESASKAARSASSKPETSQTSASQPSAASQSQTQPSHEENNNETTSTASAPSTPSSATSTSKASTSSVTSTPSTASTNNGQTTDQNQTSTDQGTDTTGTNGQ

SEQ ID NO: 7720 - protein, 150 aa, Lactobacillus casei
MDNTTIALKQLKQHGYRVTKQRESMVDYLGRNQHRYTAVTILDRYMRTQFPGVSHDTIYRNVKSFIEMGILESRMQDDQIVVKLQCDFQHPHHHHFICTNCGKVIELKMCPLNYFEDQVPGAKIQSHNFELYGLCAECQKRANSLKEANA

SEQ ID NO: 7721 - protein, 37 aa, Lactobacillus casei
MAEKTDYASAARRLKSKNPKTRSRAKRVIKAVKKPTK

SEQ ID NO: 7722 - protein, 200 aa, Lactobacillus casei
MKAAHKLIVITGATGTGKTTVSAYLRDNYRIHRVMTHTTRPARKGEKNGVDYYFETPASFATKHFIEKVTYAGYEYGSSHESLEKNWAKHPFLSIVLDTKGAITYVQELPKEVVVLFLTIDDPTVLKDRLLGRGDDPAMVAARLKSPEYKRDLTLPDELKPFATVIKNDSWDEAREQVDRFMKDLALKSCGLISLNPERK

SEQ ID NO: 7723 - protein, 135 aa, Lactobacillus casei
MIKIDNRKLDDEAVLALYQAVGWVMYTRDPAKLKRALAQSLMVLGAFDGDRLVGLIRAVGDGETILFIQDLLVLPNYQRQGIGRQLVNALVDQYPEVRQRVLLTDDQPDTRAFYEKIGFVSSDHFGVVAFYQDLA

SEQ ID NO: 7724 - protein, 397 aa, Lactobacillus casei
MRLRQLVTGAITVATLAGVGVSGVAATTVRAADDKSSLQAKNDDLMKQLQAANDKSAKLSNDVSNKVLAIQKAEAEIKDTQAKITDLDGQLTKANQEASQRKNNLKDQLISLQKRVGNSVTGNVYFDFILNSSSLTDLVGRSFTVSKLSQASTEALQAVKDSEAKVKDLKANQEAKQKSLVATKAQLESDKAKIDGLKADADKAAAEAQKMIDANKDKLAELAAEEAAKTAAAQKAVSDAASTTSTSTASSTSTASASNNASSTSVTSSTAPASAGSSTVSVSGGSIASNAAKYIGVPYVYGGTSPSGFDCSGLIYYAAKEAGVSLPRTSQAQSTLGSYVAVSDLQAGDLVFWGGVGSAYHVGIYIGNGQYIHAPAPGQSVTVQSMAYFAPEFGRRL

SEQ ID NO: 7725 - protein, 423 aa, Lactobacillus casei
MTETQRGKILDELKWRGALNQLTDEEGLRKLTQEKAVSVYCGTDPTGDSLHVGHLIPFMILKRFQLMGHRPVIVIGGGTGSIGDPSGRNSERVLQTMDTIATNKKKLTAQMENLFGTEDFRIVDNYDWLSKISMLDFLRDYGKLFSVNNMLNKEVVASRLETGISYTEFTYQILQSVDFLHLFKHEDVQLQIGGADQWGNITAGIDLIHRIEGPDARAYGLTNPLMLKADGTKFGKSAGGAVWLDPEKTSPYEFYQFWFNQDDADVEKFLKFFTFLSRDAIAELVEATKTHPEKREAQRELARSVTKFVHGQKAVDQAESISAALFSGDVADLSAEEIKQGFKQFPKVEAPKTAENIVTWLVDTTKIEPSRRQAREDIQNGAITINGTRQRELDFEVDPSTHFDGQYVIVRRGKKRYFLVKIK

SEQ ID NO: 7726 - protein, 257 aa, Lactobacillus casei
VKFIFDVDGTLSFDGQKIDQRILMLLERLKERRHEVVFASARPIRDLIPIVGPFANDSLIGGNGSIVSQHGKITFCRTIDNDDYQYVKTLIAKEKLDYIVDGSWDYAACLSSGSPIFKQLDPGHLAHRRPLKDILQPIKIILLNLTDQQMVQLFDSLQTETSLSIVASLGEHNLDLTTRDVNKYTTAQSLFPGDYVAFGNDSNDRALLLHAKISVWIGSLLTAKRAGIDHPDQWYPASNEGVLKALDGLLKDESFKN

SEQ ID NO: 7727 - protein, 314 aa, Lactobacillus casei
MDAGRNILKDEQRRFARLKSAQHAAALNLFVYGGLTVAELWIAQLAHSRALAADGLNNLTGVASALILLWGLQISQQRPDNEHRFGHWRFQTIATLFSGLIMLVVGADVVLDGYHGLQAWAQGKVQVPGILAVYVSLAAGIAMGAISLMNHIRAKQLNSSVLRTASKDSFSDAATSTGTLLAILGAKAGWLWLDGGAALAVGVLILYAAWTILRDAIFELTDGFDTKKIAAYRQTITQVPGVLGVQSIEARYAGDAVLLTIGIRVDPKMTVADSYELGEQVERKLMDKYDILDADVKTYPADLPPNDAPQDPQN

SEQ ID NO: 7728 - protein, 118 aa, Lactobacillus casei
MAYSSAQQEALKEFKQDIGHLNALSNTNRQRLIMMLGAAKNNSGVKVSDLADAIGLSQPATSHHLKRLKDIGMVASRHEGNMIYYYLTLDDTIARLERLASALRRQTEEYETGESQDS

SEQ ID NO: 7729 - protein, 309 aa, Lactobacillus casei
MTTTTTFHGLGADNTLTIYTDGANELLNQSVSMIRAYAHLLSLYDEESLLVMINNQAGKTPVHIPVRPVFNLIAQAIAWSKRGLGYNALIGPIVKLWRIGFADARIPSASEVSAALALTDPNLVELDSENQTVFLPKEGMALDLGGIAKGFIVDQVYDLWDKTGVEGGLIDLGGNQRLVGKAASGIPLWQWPIADPRYPEKRSIATLTTEPKAVVTTGIFERQSKIAGKEYHHLIDPNTGYPVESNMASITVVADNGLLGDVLSSIGFYAGIPAGYDAVEAEGQEAIFVTKETRVYQTSGLRETLAITV

SEQ ID NO: 7730 - protein, 592 aa, Lactobacillus casei
MFQFDSFTDRRPFGAVREGTLVHFSAKADGAVTQASLVIAADGQWDQAQSLPMTQSPNGYTVTFAPPSSGLWFYHFELQTDEGRQRFGAVDGGYGGLGQTYSDNADVVSYQLTVVHAFDPVPDWYKNARFYHIFVDRFQNGNADGHVNAPKANSFIYGRQSDRPMYIRGNNGEVLRWDFYGGNLAGIQQKLPLLAARGINALYLSPIFQARSNHRYDTGDYYAIDEVLGTLHDFKQFLAAAHRQGMHVILDGVFNHVGADSRYFNAVNEYNDVGAANSLDSPYASWFSFKRFPDDYNSWWGVKDLPAINKDNQDFHNFIAAKKDSVISYWTDMGVDGWRLDVADELTDGFIRQIRSTLDQFPERVLIGEVWEDASNKQAYGKRRQYFEGGELNAVMNYPLRSMLIDFVGGKLNAAGFVRQLMTLKENYPPNAFDFNFNNIGTHDTPRILTVLNGDRQKLKLLVSLFYWLPGVPCLYYGDEAGLTGGKDPDNRAFYPWGHEDHEIMDLYQIAIQTRIDQPALAVDAAFFPFTFEDSFGFVRQNEEQTLVVLANPTCSPQALQDANTKLVPANLRALLPVGTMVPPCSVIWQEL

SEQ ID NO: 7731 - protein, 805 aa, Lactobacillus casei
MSLTKEQFITEFKDMALKLYAAPIEDLSSQQLYQALALLTRSYIAQPWANTKERYDEEETKQVFYFSIEFLPGRLLQSNLLNLGILDEVEAGLEELDLHPQKIFAAEADPGLGNGGLGRLASAFMDAMASVGMAGNGNGIRYQYGLFKQAFVNGYQVELPDDWMRNGFPWETRKENRAVTVKFGGWVELRPSRSGHLRVIYHNTDDVLAVPYDVAMVGYRNGVINNLRLWSAEAPINAGPHFTLEQRERINQITQILYPDDSDNAGKELRLRQEYFFTSAGIQSIVRHYRRTHNSMAGFADRVAIHINDTHPAMAIPELMRVLMDDEHVGWDEAWRITLKVMSYTNHTLLSEALEVWPIDMFSGLLPRIYQIVQEIDRRFRLAFVPQFGQAMIDRIAPLGNGQVRMAYLATIGSHAVNGVAPLHSELLKKDVLHDLFQIFPERFNNKTNGITPRRWIQIGDRPLAHLLDKKIGTAWRQNPLALRKLHDYIDDTRFLADLNATKAENKRELAKYIDQTVHVKVDPDAIFDVQIKRLHAYKRQLLHLLGILDAYLAIKRGEKRPKRLHIFGAKAAPSYVYAKEIIKVMNAVADMVDSDPEVSPYLQVVFLPNYGVSMAEKIIPAADISEQISTAGKEASGTSNMKLMSAGALTLATLDGANIEIKNAVGDDNIEIFGLTEKEIAGYYQRGDYRSRDFYEKDPRLHAVLDMLVNGKIPGIETEGRDIYNALLMYNDEYFVLADFESYLAANARLDKLYQQPELWAKKALVNIAESGRFSADFTVQRYGREIWHVVPQTPEDDGTDTEG

SEQ ID NO: 7732 - protein, 481 aa, Lactobacillus casei
VLKVLFTAAESAPFYKTGGLGDVTYALPKAIKKQGVDIRVAIPFYEKKFPAKYLPKVKNLTHFTLEMGGRPVYVGLKTIKLGDVTYYLIDNRQYFDRDGLYGYWDDGGRFGFFQMAVIEMLQVIEWIPDIIHANDWHTAFIPVLLKEKYGWIRPYQNIKTQLTIHNLQFQGWFPPSILDTVFQIGRQSFNDNGFAQDGSVNWLKGGINFADLVSTVSPSYAQEIQSPAFGEHLDGTLRKQSGKLVGILNGIDAEVYDPETDPHLAYHYNAKNLKGKANDKRVLQEEMHLPKRSDPLFAMVSRLTRQKGADLLVDALENFLVQNNVQVVILGTGDRDLEEDLLSMQDRFPGQLAVRINFDEAMAQRIYAGADFFMMPSAFEPSGLAQMMAMRYGTLPIVHETGGLRDSVTPYNAETGAGNGFSFWEYNAGVFAKILRMAKNVYADQPKVYARLQQQAMAMDFDWHHSAAAYLKGYDRILGKA

SEQ ID NO: 7733 - protein, 389 aa, Lactobacillus casei
MRKGDLAAIIDLNEKDDQIQPLTAARPIGTLPFAGRYRLIDFPLSSLDHANVRSVAIFLPKSGRSVTDHIRSGSTWNMDQITGGIFTYPYMAGRDYEDPQLRARYYDDYLQFLRKSSAQYTIIMGTQNVANVDVDAIVAYHQAGESPVTAVYKNLPETAMQPEDLTLDMTELGTASSVVPASENRGHLKEGKIPAFMDIYLIGTIDLIDLLIDASEAPTFKRLPQIMREAVLQNNANAFEYTGFLAKLNTIQRYYDANMSMLEDQNYQALLYSANSIETKNKNEIPTYFSTESKVTNSLLGTGDFIEGDVNHSILFRNVHIHRDALVDHSIVMQGSKVGTGSSVKYAILDKGVIIGPNLALEGTPEEPLVFAKNQKVFQPDGKGVTARA

SEQ ID NO: 7734 - protein, 376 aa, Lactobacillus casei
MLGIILAGGQGTRLGKLTKTTAKPSVPFGGRYRIIDFTLSNLANSGVNTAGVITQYQPLELNRHIQNGASWGLNERGAGVTILQPYASSEGEKFFEGTAHAIYQNIAYIDSYNPQYLLILSGDHIYKMDYQAMLDYHKAKKASLTVAVMPVAKDEAKRFGIMNTDDTDRIIEFEEKPAKPKSNLASMGIYIFNWPTLKQYLTESYATDGAMEDFGHDVIPAYLTHNEASYAYAFRGYWKDVGTIQSLWEANMEFLNPNNPLNIGNRNWRIFSQNEALPPMFLTKTAKVSGSMIVDGCYVAGAIEHSILSQNVKIGEGSVIKDSMIMPNAVIGKNVTVDHAIVGENAIIGDNGKVIGKPNEISVVGYGEVLGRTEKE

SEQ ID NO: 7735 - protein, 686 aa, Lactobacillus casei
MIQGLKDWLYLFNTGQDFQSYNRFGAHEVEPGKWSFLVWAPHAKQVQVVGDFNDWHGSPLKLQGQTGCWYGELSAQKHQLYKYQIVGPDGATHEKIDPYGFGFERKPGSAARLVDVPRITWHDDTWLAKRSKWRPYDEPLTIYEVHLGSFIRDTNAGPDGGYMTYQDAIDKLIPYVKDLGYTHIEFLPLMEHPLDASWGYQLMGYFAPTSRFGDPEDFLRFVDAAHEAGLGIIMDWVPGHFIKNTDMLAQFDGTPTFEYTDPHRAENVRWGTWNFDLGKAQVQSFLISSAMYWLDHCHLDGLRVDAVSNMLYMDYDAGKENDRNQFGGRDNLEGIAFLKRLNTKVFAKHPDVLMMAEESSAYPKVSAPINTGGLGFNYKWNMGWMNDTLKFFEEDPVYRHSDMNLLTFSFMYMYNEQFVLPFSHDEVVHGKKSLMHKMPGDRYNQFANLRTMYVWQTTFPGKKLLFMGSEWGQFLEWRDWSQLEWVDLKDPMNKKMQGFTKTLNHLYTARPSLWQQDHQPAGIKITMADEPDVMSYIRYGKQPDDFTVVAMNFVPVQKDHFKIPVPRLGTYTVLLNTENIDFGGTWTKWQATLTAKEGNTHGEPAWLDVILPAMGALLIAPKKLAPLPKPPKQQSKHQPAITGSPSPKAIATQKREAISHHKDWGTTPARAQPPTTSLSVKKNKSF

SEQ ID NO: 7736 - protein, 393 aa, Lactobacillus casei
LIKTHKIKLYPNATMRRELERLFNYRRFVWNQALETWNAMYDASLVMADKTLRPNERKVRNELVWNKADWQYEQSARVLQLAVNDLSKAWKNYFNPKMPDHDKPNWKSKKRSRKTFKTDRAQLVNGKLRLDKPHGAGTWYDIKLAEQPRWQGELKQVCVVQDADGYYASFSIEVQTFVEKRPALTVTGVDANIGKFDYQTSTGYATQPTLPDRLPVLYTRIAHYQRQLARKRKVNPKRFNSAAYRTTRTKLKRQYQRVERIQTDLLQKFTTMLVTDYDLIGIEDLDNHHMRMNKRLAKNLHRSLFGKFKVIMQYKADWYGNTLVLADRFYPSTQRCSRCGYVKTADERVTLRGNLKHRTGHDDYHCYQCGVKLRRDENAVENLVAYAKSKVTG

SEQ ID NO: 7737 - protein, 343 aa, Lactobacillus casei
MSVDIDWNNLGFDYMQLPYRYVAHWKDGAWDEGTLSTDPNLSLNEGSPILHYGQGAFEGLKAYRTKSGKIQLFRPDQNAHRLHNSAEKLLMPPFPEDRFVDAVKQVVAANHDYVPPYGTGATLYLRPMLIGVGPNIGVAPAKEYIFDVFAMPVGPYFKGGMVPTKFIVADQHDRAAHYGTGQAKVGGNYAASLQAGKFAHEHGYGDAIYLDPIEHKYIEEVGSANFFGISKDGKTLKTPKSPSILPSITKYSILTLAHDRFGMKTEETKIAITDLDQFGEAGACGTAAVITPIASITYNGHEHVFYSETEVGPYTKKIYDELTGIQFGDVPAPEGWIVDVPVD

SEQ ID NO: 7738 - protein, 528 aa, Lactobacillus casei
MLRKSLMTFALVASGLVVTSAVGFHMQHQDVAGSRITTREKVNAVSASSDLLNAKLAALPVEQTGALAHGASGSGVTTSQTASPTQVKATPQYHVSVVKNAPVSSLKYFGLQVSNSAASQTEAKTTAVKTAAVTTKASATAASIAAAVKTTASTVSAVKTATVKQTATAVAKKTTVAVDLLDATAAVQPAGQAVAHPKWSVVASVTSKTTTKQPAATSTQVSTSKATASSAVAVTTTKATTETQVSSVPAAPAKVTTSAPAASTTTAPATKAPAPAAKASTPAATSSSTKVDLLNSTAASQPANQSVAHPSWSVASGTVASQQPAAQTAVKASTPAPAASKASVASTPAPAAKPAAAPSTRQASAPAATPAPVQQAKPAPVVTPAQPVKPQVQPAPTYASRVLMFAGVTVPYIIGNESMDAAPANGAATWGGQANYSNNSGENTHFIGHNPGAFAAMLSLGIGSPITVTDAAGQARTYHVYRLATVNPNAVTADGQDLWDDITGTGGGQRITLQTCVGDYWRLIAFAR

SEQ ID NO: 7739 - protein, 276 aa, Lactobacillus casei
MQKTMRHPVLKWLWIMLALTLIAVSINMFYAPHAVAAGGATGIAILVQEVAGVQVGITTMGVNLCMLALAWFFLDRSTLKRILFGSFMLPLLLWLTPEINLVTDRLLAIIVGSVVFAFGVGLLYQMDASSGGTTVPPLIFKKYFGLKPSLMLLVTDIVVSLFNIPVSGVEAFILAVFALTITSLVMNYVETGFDRKKVVYVMSDQLPLIKQQIRDETSHGLTVQQVVGGFSDEAKEMLMVVVEQSNFKQLIELVHAVDPHAFILTVAATEVHGGSI

SEQ ID NO: 7740 - protein, 643 aa, Lactobacillus casei
MDLYSELTAKYQTIPAIATEIINLEAILNLPKPTEAFMSDIHGEYNAFQHVLRNGSGNVKSKIRSCFRDEMTEKTLQRFAFLVYYPSERLAAIHQEMDGDDLQQWYLTTFRRLIRLLAFTATKYTRSKVRKAMAPEFVYITEELLYNDASMQDKLAYYWQIIHNLIVLEQADEWIEATCRTIQRLTVDHFHIVGDIYDRGPAPDQVVESLIRRDQRHSVDIQWGNHDILWIGGAAGSALCIANLVRISARYNNLSILEDVYGINLRHLARLAEQYYQDNPAFSPKLGRSDRPITEAERLQITQIHQAIAMIQFKLEGPTIKRRPEFEMDHRLLLDKLAPDFTTIDLNGHTYPIENGCFATVDPAYPYRLLPEEKEVIDSLVESFTHSEKLHRHMDFLINRGSMYLRYNRNLLLHGCVPVDEDGNFIGLTIDGTTYAGRQLFDMLEANLRLAYSQPDEKADLATDLLWYLWTGPNSPLFGKHDMTTFERYFIKDPATHVEGRNPYYHLRKDPDFIKKILEEFVLDPEVGHVINGHTPVKKGTDPIMANNKMIVIDGGFSKPYQKTTGIGGYTLLDNSYGMQLVTHQPFTTKADAIANLTDIISTRRVVETEARRRTVAETDIGTALQAEVEVLKQRLAELRNED

SEQ ID NO: 7741 - protein, 133 aa, Lactobacillus casei
MIKLYTSGSSKSSREARAWLEANGLPFEEISLSKQGISKAQILELLARSEDGIDSLVSRRSKAFQALDVDFDALSLKEAVDLLSKQPAILRRPIIVDDRRLLFGFNQDSVRVFLPREVRRQKLWAALLNTSSV

SEQ ID NO: 7742 - protein, 717 aa, Lactobacillus casei
MANFNDPFFNNHDMDDIFNQMLQGMGKGESARYVVNGHEMTPDEFAQYRATGQLPKQGDEIPVATTGEQAVKKGGILEKLGRNLTQEAKDGLLDPVIGREHEIQETAEILSRRTKNNPILVGDAGVGKTAVVEGLAQAIVKGNVPEAIKDKQIWSIDLSNLEAGTQYRGSFEEKIQNLIKEVKAAGNVILFFDEIHQILGAGATGGEESGGKGLADIIKPALSRGEITVIGATTQDEYRNTIMKDSALARRFNDVTINEPSAADTVKILDGVKKLYEQHHHVQLPENVLKAAVDYSIQYIPQRSLPDKAIDLIDMTAAHLASKHPIVDKVELEKQIKDLNAQKDAAAKAEDFEKAASLKKEIADKQHQLEGTNDEKPVVATPNDVAAAVERLTGIPVSKLGASDIERLKGIGKRLKGKVIGQDEAVDMVARAIRRNRAGFDEGNRPIGSFLFVGPTGVGKTELAKQLALDLFGSKDAIIRLDMSEYSDRTAVSKLIGTSAGYVGYNDNKNTLTEQVRRNPYSIVLLDEIEKADPQVLTLLLQVLDDGRLTDGQGNVVDFKNTVIIATSNAGFGNEALTGKKEKDEDLMKRLAPYFRPEFLNRFNGIVEFSHLTKKDLGKIVDLMLEDVNKTLAKKGITLTVTAAAKDWLIAQGYDEAMGARPLRRVIERNIRDKVTDFYLDHLKAKKLQADLVDDTIVISEAQPTSGKPKKEAVGAK

SEQ ID NO: 7743 - protein, 254 aa, Lactobacillus casei
MIDVHCHMLPGIDDGSKDLTTSLELAEAAVADGITHALMTPHHMNGRYTNHAADVIRLTDEFQDVLEQRHIPLTVFPCQEVRINGDLLEAIDHHDILTCDVTGHYILIEFPSDDVPLYTQNMLFEVMQRGMVPVIVHPERNTRLMKHPGLLYQMIERGAFAQVTASSYVGTFGKKVQQFSEDIIDAGLAHVFASDAHHLPGRSYEMSAAFKRLERKRGEKKAKIFEDNARALVNGDPLVRFNERKVEKRLLSRY

SEQ ID NO: 7744 - protein, 297 aa, Lactobacillus casei
MKKILVRVLLVVLVAALGFGGFVYYMVHNSTSQIYSYNKKTNKSSDDKTTSGKPVAYLLLGTDTGELGRSYKGRTDTMIVMVLNPKSKTTTMLSVPRDTKVTFDDVTIKINAAYSYGSSDTAMEAVEKLLNIKLDGYLLVNMKGLEQMVDAVGGVTVTSPLSFDYEGKSFVKGQSYDLSGSDALKFSRMRYDDPQGDYGRQMRQQLILASVINKLKKNPTTVLSQKFLNAVGKNVRTDVSLGSVKNLATAYRDAGSSIKSDQLHGTGQNIDGQAFEVMSDTELARGHDVIQKALDAK

SEQ ID NO: 7745 - protein, 243 aa, Lactobacillus casei
LGGFAAPTLLILEEISLEKQLEKTQHRVEVLESEPANVSSVYLFEKRVFDIICGLFGMVLVIVTALILEPFCLVGRNKGPLFFKQTRVGQNGRKFKIYKFRSMVVNAEDVLHKDATLYDKYVSNNYKLPPKKDPRITKLGIFIRKTSLDELPQFINILKGDMSMVGPRPVVESELREYGQHVDQLLTAKPGAMGLWQASGRSKIGYPQRADLELSYVANRSFSYDLLIICKNLVSIFKADGAF

SEQ ID NO: 7746 - protein, 265 aa, Lactobacillus casei
MHISVLIATHKPYHMPSDPAYLPIFVGSSLHSEIPNGYQRDDQGINISDKNPHYNEVTAIYWASQNLNADAIGLVHYRRYFSNRSFAQKKDFSSILRESQIEDLLKRSSIIVPKPRNYYIETIESHYRHSHSAIGIDALYEVIAQQPAEYRESFSKVMHSKQAHMFNMFIMRREEFKAYSSWLFSILFAVEAKIDFSKLQGNESRVMGFLAELLMDTWLLANNKTYLECPVIFMENEHIVRKARNLILNKLTGTHVNLDTHIGTK

SEQ ID NO: 7747 - protein, 365 aa, Lactobacillus casei
MRDKEKIKTLVILPFLSGEGGTETVVNEWISHFEHSSDFEMSFLLPQGSMRDHWYPSFSKKVKVFKFAQLFRNRRSIRNLFGAIWLAFAVLFTSADEVVCLSTKLIYEVAFLKRLFHKKFRIISWIHFSLLHGQDVSLDDLQKADYHLAISTGIQQQMHDINIEASRIGVVGNPVSPTTNVIPASTDGITRFVYSGRIFVDGEKNLRELVLGLNKLNKLTKQWTLDVFGDGPDMSEFKELIAQKGIASQVTLHGWVTQPLDKLAHADCLVLTSTYEGFGMVLAEAIARGIPVISSDCPTGPADIVNDSNGYLYRPGDVSMLTEKMIAIINKEKVFNHDDLPSTVSKFYSKSYFNRLEQFLVAFSE

SEQ ID NO: 7748 - protein, 382 aa, Lactobacillus casei
LKVLLVGDFQYGSGMTVYMMNTYKQLSKKGVKVECVSYSGKHDFEKETNALGWPVYYVTRVGKNPMKHWIDWARFCKQHKQSYDIIHFNFSSSWNFLPVVFAHYFTNAKIVVQSHNTDYSKPIKSHVFKATIDTVNRLGRHIFSRISDLKLGVSNESLAWMFGKDNQGIVLKNGIDLRKFLFSEKPRHDLRQSLGLGNETWVVGMVGVLTERKNPFFSLKIFEELHDRHLESHLVIIGNGELREKLEQEVHQKGLDADVSFIKHTDAMNDWYTAFDVLLFPSLFEGFGFVPLEAQASGLQVVASDQIPHDVMLTDSIVALPLNEPKMWIKNLRSYLDKLPVNRNDISERNIESIDLAGYSIVSSAAILKQWFDKLLLQEESI

SEQ ID NO: 7749 - protein, 209 aa, Lactobacillus casei
VPTNAMRKFIENTNKVSAKVVVFGLYEHLADSLDVPTFKNQRTMIFAGNLDKSSFLSKLTHSTFHYEIYGNKPSKFALPESLDYRGSFPSDELAAQFSGGFGLVWDGSSVDGISGVMGDYLRYNSPFKASMFLASGIPVVVWKNAAIADFVSQHRLGITVNSLAEAESAIKQVTDEQYAELTASVRSFGLQLRQGAQFKKALEDVLTFV

SEQ ID NO: 7750 - protein, 207 aa, Lactobacillus casei
MKYCIKCGELLKKEDQFCDHCGAKQPHIEESSHSIELNDLNGLKGRQGLEVDSNNKRRSMKPYPISIVGLIAIIVIAFVGLQSFNVYKRNNLTQQEIADIGATVVDEHMSGCDVSYSKEANQLTINASEGSALYDKLIDILDDQDSPSELKTVKNSLEKISAELSPKMPTSLKDVNIVLLNPLNSNLDLYIASEGEVTYDYIKENDD

SEQ ID NO: 7751 - protein, 387 aa, Lactobacillus casei
MANNSDKINFCVNCGERLTTQSNFCPKCGKPIKQIKSVSNNASGMRLTQRGPALNQKAAEHSSIWQSATTALNHYTGETGPVNINLKNLFSEVFKRHSQNEAEEIFIAGTVTTTPTVSEVSADWGRPWLFSRILMFFGAIFMLLVYIAADMDNSNAIPGVIMIGAFTVPFSALVFFFEMNTYRNISFYEVLKVFFLGGALSLFVTLFLYQFVSFSVQNQVYGMMTWSDTISVGIVEELGKLFIVIYFVRRKNYQYILNGILIGAAVGGGFAAFETAGYIYNSGNLLLQTALLRAAIAIGGHVVWAAISGGALVMVKKSERFNYHQLLIPNFWVFLGSVIVLHALWDKGIALMGSLMITYITLIVVAWLIAFVLINAGLKQVSRIKQG

SEQ ID NO: 7752 - protein, 194 aa, Lactobacillus casei
MAKIGYARVSSKEQHLDRQLVALKGVDKLFTDKLSGANTNRPELQKLLAYIRDGDIVIVTELDRLGRNNQDLTQIMNTIQNKGATLDVLNLPSMSGIADQNLRQLMTNLIIELYKYQAESERKRIIERQQQGIALAKQKGKYHGRKPQYAEDDPRLQHAFTLYQAGMSDVDVARNTGIKRTTFIRYRKKFKVYN

SEQ ID NO: 7753 - protein, 97 aa, Lactobacillus casei
VNYYNDLGTNQAAVYTFGPADVVLTVTNFIGSRIFGMEILSNTKNSRPRFISTLFVGNALKSITDFCNIKLLFDKGLGSYVDKLKHEIQLNIDEQMK

SEQ ID NO: 7754 - protein, 595 aa, Lactobacillus casei
VADSKYDVQNSQIGTLLGWINSGEIGLPELQRPFVWPSTKVRDLIDSLFNGFPIGYIITWNNPSIRLKDGSISVGKKIVIDGQQRLTALATALSGQKIIDRRFKRRRISIAFNPLTREFQTANALLQKDKRWISDIAEVFADDFSSFNFITAYSQANDCPPDEVARAIDDLKHITSYGVGNISLSDALTIDQVTEIFNRINSQGTRLSTADFIMSKMSADTLHQGNIQRKMVEYFTNLQADASALSGIQESDPKFAQSAAMQKIAWIVSENTTLYQPAFGDIFHVILGSHFGRGKHADLVALISGRDFETKKYTETAMAAAYSKLGEGIDDFVNQSDFRRFIMILESLGMISGKLQFNGTAFLNAGYMLFLILKGQNGIPQSVRESLVKQWIIMSALTGRYSGSSETQMEQDSHLFHRADVVAAVEKEIADALPETYWTIQLPNNLATQSTQNNGWRIFQMAQVHNQTVAWLEKDVTVRTVISQEGNIHHIFPKAYLRKHGAQQNEINQIANYCWLTQPRNLQISDLAPERYMKDPAVTEFSTAKGLAENAIPVDIVNGNFSTYPDFLNQRRQLMATVIAEYFSRLKPSAVPGQS

SEQ ID NO: 7755 - protein, 709 aa, Lactobacillus casei
LTSDNKQEEEKLRAKSDGDVAVPAEPIAQEQAAENVQTDLLDKLEAFFPGRFVRKDLTQKIKEGANVPTYVLEFLLGQYANSSDPVIIERGVENVKKTLANNYVRPDEAEKVKSRIREEGAYTVIDKITVTLNSDKDRYEAAFGNLGITGVPVDERYVQDYERLLVGGIWSIVRVRYDHTSDDHFLIDQLTPVQVPSVNMQEVYDAREKFTTDEWIDLLLRTIGMEPTQFDDRVKWLMVSRLIPFVENNYNFVELGPRGTGKSHVYKELSPNSILVSGGQTTVANLFFNMARHEVGLVGMWDVVAFDEVAGIKFKDNDGVQIMKDYMASGSFARGRDEIQASAGMVFVGNINQPVDVVMRTSNLFDPFPAVMANDTAFLDRIHNYLPGWEIPKYRPNFFTNGYGLITDYFAEVMRALRKISYGDAFDKYFTLGNQLNQRDTIAVRKTVSGMVKLLYPDGKFTKDDIAQILAFALEMRRRVKEQLKKIGGMEFYDVNFSYIDKETYDEHFVPVPEQGSTGLIPENEGKPGQVYTVAYDADERLSLIKLESQMTTGNGKTSWTGIQSNRLAKEEMDTAFNYLKANFSQVSQNIAPAQHDYIVNATNLNNDAMATELSLATYVALVSISVGKPVIGGLAILGDFSIGGTIKKMDSLADRLQVALDSGAKAVLIPSSATSELGTVPGDLIAAFSLKFYNTIEDAVMKALGVQQ

SEQ ID NO: 7756 - protein, 844 aa, Lactobacillus casei
MAELDTKKIVAGIEKLFADNNHFVFWYDAQGEFADNIADITEQLREPVVIMGKNEQFKTKLTLVAMERQGQSALIYSPAPKPDLTENFMTDMLYYSREYTANALVMLRQELRVPDEDAATFQEQKRFFASKDRQAKFQRLYQPGKDLQMAIMAALAGASDHTMTMVLRAVLQAGIGDTNPVLAEFKKYGLLTQFWENVRNAYGFNGATNSLLDFTTALYLNFAYYQMEKDLPRSIDNYKLTSANNAVTFLSLARNDQTFADTYRQLAETVWQHLESFSGVSRQLQQLDIVDLLKTDVFANFDRQILAWVVQRLQADDFHAVAGTTPLADVLTQREKMYFGKTYHDAYALLQAALVILTYRRREVKNLAAAKEQYITTDYAVDTAYRHFVQRYDRIAIDLTDLLEGIADKVDNTYVNEFLTPTVTAWTTVYDPRDIEPNSWQRSFYRSFISSAKERIVVIISDAFRFEAAAELKRKLDDQDVYSTELDTVYSELPSVTYFGMPALLPHQTLTYQPDKTVLVDGLKADTLGKRRQILQNRDPQSNADHVMTFLKDWDTPQRKQLLAGQKVVYLYHNEVDATGDDAKTEKQIFNATEEAINTIARTIGFLRNLSVAHIIVTADHGYLYKRSGLDSADKIDISGHDLDVLGQRYAISSETIEQPGVRSQRLGALLDNDDQRRVYYPATDSIFKSAGAGQNYVHGGASPEEMIVPVLHVRTQSGRSKATPVSIKVTEGAHRITSRSVMVPISQEKPVTDKTTAATYVLYFVDSQDRPISNEQRYVADSREDDPQSPSRRQSFYLTLQDRDFDNSGAYYLIIQNAETKEEIQRIQYQMDLTIKGDFGFDI

SEQ ID NO: 7757 - protein, 283 aa, Lactobacillus casei
LIHDFEVGKPLSEYVDPRQGLATTDNKKYLRQWFEISFPSIHFSAHSTEEALQSGAKWFPYNKGGAYRKWYGNYDYIVNYQNDGEEIKRDVLRKYPYLKTPDFVVKNTDYYFREAITWSDITSGSFAARYRLPGSIHDVTGMSIFFNRAKSNIHEILAALNSRVANEIFSMINPTMHLQIGNVTNFPVLEVGAEKDVKMKELVNSSITQSRAEWNSFETSWEFLLHPILRYIAEHTVLVICHIHRRISKIRVTAKHPFKKLATWWHKIQNVPKKCQTFGLGGH

SEQ ID NO: 7758 - protein, 293 aa, Lactobacillus casei
MVSYRKRGKVWQYEISYKDLDGAYKKLRKSGFRLKSDAELAASQVKSLYADVRQFKAGEIPLSIYFERWINLYKRNSVTNVTFVKYENTLNHIRKIFGKMPLKDITRTVYQERLNVFARDHAPRTVSAFHKQIRAALLDALDEHIISNDPTRKAVVTGVAVHRPKKALDYGEWQKLIHHLDPDQIPEMMIYLAAVTGMRYAEILGVTTSDINWQEGTVDVNKTWDYKYHAGFKKTKNKASMRKLPLDSISLHRLRVFVENHPTSPNAPLFLINGHAMVSAEINQVLTNKLRTL

SEQ ID NO: 7759 - protein, 1215 aa, Lactobacillus casei
MDKKKIHDFAVKARRELIESVELKLTQVGITRDGVKEKLPTSTAEIAFYVPNDTEGVSGRDTSRRVSLVQRLQTAAAKDDWHTAYDNLVEEASYTWFNRIIALRFMEVNHYLPSRVAVLSSEEGRAEPDILAHALEIEDDLGGFSDEQRDLIQHAQETQEPAAMDNAYRLLFLKQANALNANLPHLFEKTTDAFQLLFTPSYQNGVIKELVTEVPRDDFDVEKEGQVEIIGWLYQYYNEEPKDIAFKKSKYAASDIPAVTQLFTPDWIVKYLVENSLGRYWIDVLHTRGDQRSEQDIAQSFGWRYFMSAAQQTEDVQQQLLAFNSHLSGKKLQQITFLDPAMGSGHILIYAFDVFMQLYQSEGYSAREAANSIVANNLFGLDIDRRAYQLAYFAVMMKLRQYDRRALNQSIDPQLSDIPQTNILNDDLNELTRAYANQLPQQQAKSFQGTVKEFNRGDVLGSLIKPSLDQGILSELQTSAATEPESAQLSFATTNFNFEEMSRITRVLTILAAQYTIVVTNPPYMGSGKMTPSLSKFVKREYPDSKADLFAVFMELAQKLNVQNGYHALITQHQWMFLSSFEKLRVKLRKNVLINMAHLGTRAFEEIGGEVVQSTAFVMRNASIPSYVGTYERLVNAPSQTAKEDAYLEMVKDPSCKGLYRTNQTNFGKIPGSPIAYWSSMNLIHDFEVGTPMSEIVDPRQGLATADNDRFLRQWFEVAYQTIKFDAKSIDESISSNKKWFPYNKGGSYRKWYGNYDYVINWHNNGEEVRNFKFPNGKQRSVVRNPNYYFREAITWSLITSGGFSIRYREPGSIHDVSGMSAFSNDHNQLMRIMALLNSPVGEHCFKMLNPTINLQVGNVTVFPVLHSAIEAPTWDSLIQNSVKLTKQDWNSEEQRWGFWTLPVLIHIAEHNRNWTVEAAFNQWKQEAQDRFDQLKKNEEELNKIFIDLYGLQDELSPEESDKEVSVRNKADLGRDIRAFMSYFIGVTFGRYSLDTPGLAFAGGDWDASKYTSYQPNANDVIVLTDSDYFGDDRDIMHRFREFLTVTFGKEHLEENLTFIAKALGKAGDTAEDQIRSYLFNDFYKNHLTIYQKRPIYWQLDSGRQGGFKALMYLHRYDGDTMAMIRTSYLHTLQAAYEKRVTTLDTFIASETNTRQKNQLIKQRDHTRKQLEELVKYDAQLQHVANMHIAIDLDDGVVVNHQKVQADVKLLTPIK

SEQ ID NO: 7760 - protein, 1241 aa, Lactobacillus casei
MQIRDLFVKPIDRNIQGVIKVGQDADANVKQELDEYVVTRELKGHFDDFFAAYEKSINHDTDEMGVWISGFFGSGKSHFLKILSYLLEDRKVDGKSAIDYFKEKINDQMTINRIELAAQQPTDVVLFNIDSKAKTGAKSDDNTIINVFLQVFNEMQGFSSTNFWIAEMERQLVAQGKYDAFKDKFTELDNTHMDWTVGRDHAIFKKGTIKDALVQVDAYSEEDAQGLMDQLTTSYQVSIEDFSKLVAAYIKKTGKRVVFLVDEVGQFVGESTQRMLNLQTVVEDLGAATHGKAWVVVTSQQAIDTITDKISGQDFSKIQGRFATKISMSSANVDEVIRKRLLAKTEPATTQLAADYEANAAAINNMIDFDDGVDRPKFRSGEDFAATYPFVPYQFNLLQNVLTAVRTHGSDGKHLSEGARSMLSLFQESVEAIMDQQDTALVPFSLFFEGLRQFLDHTHSIVIAHAVDNDTVDPTHEEDNFNVQVLKALFMVKYLKDFDATLNNIVTLMIDSVDTDRVELQKKVQNALAILRQQRFVEKNLDNYEFLTDAEQEVNQAISREEVLSGELEDRMGNFIFDPKTGMTNKYTYPKLKGRYNFTLNQYVDETPQGRTNNDMTIQVITSLDGANNRNEANLLLLSMDPSKHKIVVDLPSTDDYLGDLRRAEQIGKFVMLGNAHADARFNFIKEQRTAERQQLLVKARERIMTALEQADVYVAGHKIEGGKDFQGRFTDGLKMLVDDTYRSLGLIDAAKSSSDITQILDQDNELAVSTQENERAVQAVYSWLQRTMQKDKHVTLQAILNNFKAIPYGYIEDDIEWLVAKLLADGKIQANLQDQVLSPVNLAYRSQDIANFLTKKQYAEQISIQVKKDINPCYLREMKDVADQVFNKRSFSAAQPDLMVAELKEKIAKDNGTLKFFDQKNSSFPGHELLKKGSKMFSELLAINDAETFYDKIHTRYDDLLQWADDMSDKGIMDFYFSDQQQTIWTRGLDDIARYKASHDFFTSTALAEDYQQLNKLLNEDRAGRVIQEIDGVHQKFVDTFAKIMDDHQKQVTDKIQAVNEKAKQRINDSSTGDDFKQQRLATLTEQIKRIMTEAEEAPDLTRLEAKPAAADAVLRRITQSLENEEQRLAEEQKLAEKERLEELARKKAAEVEKVSPKPSSDEESIKLVDPLPAPGPNPAPQPEPAAPVVIQTKYLEADQLPIEREWSISSEDDVNRYVEKLRQALLDQVKENQITKFTL

SEQ ID NO: 7761 - protein, 193 aa, Lactobacillus casei
MVPLKKKFQDLREKIQTQSFQENRGLSNEVGYYIFDYDPEKELYVRGEIGDIIRQEKAAPTGVTIQVFNLFTIMLTIVDQFGYREAFIDLEKSNGITQVIDWMNNIMEMNEEHNLVVQYISDHLNKDGPTIVFITGVGQVYPIIRAHKVLNTMTQVIDQIPVMMFYPGNYNSVRLQAFGELQEDNYYRAFHFE

SEQ ID NO: 7762 - protein, 199 aa, Lactobacillus casei
MKRISAGAVKFQFWFTEFVQAMGMANDNDDFTVLRQQILAENTFHASSHARLITTTGVVLRRVGSLTPAMRALFDQLDPVNQRIMNLIAIMNTEQLMYAFMYDVFRPELILGDRQIEAYEMAAFFKKLPLTHKEAAHWTEETLRRLQSTVAQYLRRAQIVKDYKDTLVIENYLLDERLADRLREENHLDYLAILTGRTS

SEQ ID NO: 7763 - protein, 453 aa, Lactobacillus casei
MLPLAFTLILILIAAYFLNNRELMSPAVLYSGAFAFSGLWALAYAGKWFLEPSSLTVLVLVGGGLEFIFVTWFIHLFFSSIRSKQVVNEHDLTRAVDNQKLNVGKEKIEEWTVATWKLVLILVVLIVGIFYTIYEIKKIGGGMSLGDAIYYVRVQTIFTINGNTLPRSVSIIRNFSLSCGFFFGYLLVREFVYFHKFSLSNVFIVLLAIVTTLLMGDRTEMVVVLIAIFCYYYCLLRTKSNWSKPNNKKFIAGIVIVGTIVLLVFPPIANMLGRESDAGSNSLDYLSVYIGAEIKNLDIFLRTTTIPVTGSVWGSQTFVNILPWFAKIFNFTLPPEGLTLPYQTVNGVYLGNVYTTYYAYLYDFGIWGVFTLVPIMAGISQLFFERIRVTKNPNHVPYSILIYSNIVSSLVLSFFSNKFFEQIFARQFVLIIFFWVFLNFFIFETGLRQSRGK

SEQ ID NO: 7764 - protein, 479 aa, Lactobacillus casei
MRWIVTKVVKNLLWNMGYQVFILLLPIVTIPYVSRVLGPTGIGINAFTNSIVQYFVLFGTLGLTMYGNREVAYQRDHPKRLSSLFWELTLIRVGTTSIATICYIGFIIIAGEYQTFYLIQGLLLVATAIDVSWFFQGLEEFRITVLRNTLVKIISLILIFVLIKTKNDLGLYILILTGSQVLGNMTLLPYLKRYVRFPHLSDLKLINHLRPTLEMFIPQIATQVYLQLNKTMLGALIGVQASGFYDNSDKIVKIILAIVTATGTVLLPHTAHSFAMGKHDEVEESLNKSMHFILVIAFPLATGLAGIAPVFTRIFFGKGFDPVSDLLVIESIVIVLIGISNATGVQYLLPTNQLKPFATSVVLGAISNIILNVPLILILGSNGAMIATVLSELLVTVYQLLKVKNQIRLHIIFREVWKYVVAALVMGVSVRIFISVLSLSSLTALFGAIIYGALIYTVALFMFRPVVLMRMLTSLKKLH

SEQ ID NO: 7765 - protein, 372 aa, Lactobacillus casei
MKLLIVGAGLFGATIARERALKGDKVDVLERREHVAGNIYTENIEGIQVHKYGAHIFHTSNQAVWEYINQFATFNRYTNEVIANYKGEIYNLPFNMNTFNKMWGVITPAEAEAKIAEQRAAMAGKKPENLEEQAISLVGIDIYRKLIKDYTAKQWGRDPKELPSFIIRRLPVRLTYDNNYFNDRYQGIPEGGYTQIVEKMLDQPNIHVELNTDFLDHKQEYLNQYDKVIYTGMIDQFFDYQLGTLEYRSLRFETEVLDMDNFQGNAVVNYTDAETPFTRIIEHKHFEFGKGNPGKTVITHEYPASWSKGDEPYYPVNNSENNHLFTSYRELAAKETPQVAFGGRLGLYRYYNMDQVIAAALQFLQGDFFNKK

SEQ ID NO: 7766 - protein, 248 aa, Lactobacillus casei
MNWLFKFGFKRNQEDQESQKNGVMLVTYAEPKHVVSEQYRTVRTNIEFAAAALDKCQVVMFTSSTMLEGKSTVSANVAVTWAQAGKKVLLLDADLRRPTVHATFRKLNLDGVTTVLTGKSKPDEVVEETFVDNLSIIPSGPIPPNPSELLNSKRMSDLLDWARGNFDIVVLDAPPVLAVSDVQVLVPKTDGVVIVTKIGQTQKSDLRRTVEVLKLAKAKILGSVERVKARHGDKGYGYGYGYGYQSNV

SEQ ID NO: 7767 - protein, 304 aa, Lactobacillus casei
MNKQIDLSQLWQILKRSFLAMIILGILGMAVAYFGAKTLIAPKYEADTSLLVNRKQDNDPNMQLNAQQADVQIINTYKDIITRPVVLQAVADDLTSPQRVITKKAEKAVYGTRYNATTGVRERYVVEKAKPAKYKLEPAKYTNLTADDLAKMVSVSTQQNSQVFTVNVKDNDPVRARDIANEVAKVFEQKIAKMMSISNVSVVSKATANSTPVSPRLNLIAIVGLGIGVLIAFMWGLIRELTDQTVKDLDFITDSLGLVDLGAVNYVQRMKDIDEVIQATKAKYDDDVDSFDGPNLPQRSRRRV

SEQ ID NO: 7768 - protein, 325 aa, Lactobacillus casei
MNLLVTGGAGFIGSNFVRFQRQNHPEDLIVNLDLLTYAGNLQNLADLQNDRRYIFVHGNIVNRELVAYVIEQYHIDAIVNFAAESHVDRSIQHPEVFYETNVKGTLTLLSEAKRKHLKFLQISTDEVYGSLGKQGYFTEKSALQPNSPYAASKASADMSVRAFYETYKVDVNITRSSNNYGPYQFPEKLIPLMITHGLTGKQLPIYGNGKNIRDWLYVEDNCRALDLVLRKGQAGEIYNVGGHNERSNNTIVQNIVDHLGLSKDRIEYVEDRLGHDKRYAIDSTKISLELGWKPITSFDAGLDNTINWYITHRNWWNLLLDKAKF

SEQ ID NO: 7769 - protein, 239 aa, Lactobacillus casei
MKKHTLRLRDLILCIALGLLIAGVGGFFYFRHYQSEQAIAVNQQTRQRIQNDSKAKVKKEKVLNQYRLFGLTDSDITAAKNLPVTAIGDSVMLGSSAYLKVLFPKMSIDAEVGRQVQAAPAIISQLKSEGKLDDTVVISLGTNGPMTESDINGILDQLGSNRQVFWVTAYAPGKAWIDPVNKLIHSAAKSHSNLHVIDWYYLAGGNDDWFADDGVHPNDAGRVHYYTLIAKDVMQTLKK

SEQ ID NO: 7770 - protein, 166 aa, Lactobacillus casei
MQTTSMSHRSIVSLTKTAIVAAIYVVMTLMLSPLSFGVVQVRFSEMLNYTALFNRRYVWAVTLGVFLANLASPTALLDVPVGTLGTLVFLVISRWAAKFVHQKWAKFAIMGVLFAFSMFTVAGELTIMSKAPFWASYATIALGEAVSMAVGGVVMMVLTRYVDLDK

SEQ ID NO: 7771 - protein, 237 aa, Lactobacillus casei
MIAFDFSGKTVVVTGAASGIGAAQAAAFTAAGARVIGVDLQPMTGLAVTIQADVSKAATAETIARNYEPDIVCNTAGILDGYQDVAATDLATWQHIIDVDLTSQFLMIKALLPGMLTRGHGIFINMSSIAGLVGGGGGVAYTAAKHAVIGLTKQLDLDYAARGIRANALAPGAINTPMNAADFAGDGKMAAWVAKETPAKRWAKPEEVAQVSLFLASDAADYIHGTVIPIDGGWLEK

SEQ ID NO: 7772 - protein, 74 aa, Lactobacillus casei
MTFEAVLPSLKNGQKAVRTGWEGTELYVQLVPEGKFEGDTLNPYFLIKTADEAFSLWSPTDCDILAEDWQLVDA

SEQ ID NO: 7773 - protein, 103 aa, Lactobacillus casei
MLDNIGKLVHQQRRSLNLTIEKLAERSGVSVSLISRMERGDVNNISVKKLTDIAQALDMEVGDFFIAPEMSDINTLALVKYLTGLPETERARVSEVLMQVINL

SEQ ID NO: 7774 - protein, 209 aa, Lactobacillus casei
MTKFYFVRHGQTETNLARRFNGGRTDTPLTPSGRAGAKAVGRFFETTGFAGIYASPMPRAQTTAKLIVAQSKVAQPAIITEEDLREVDLGQWDGRPLTKVQDDPQIDNYYHNLQAFDYKRIGAESFEHALTRGRRVITRIYDQHPDGKVLVVAHGLLGMLLLSTYLGADLNNARDEMAMPPNNSISEIDTDDGEEFTRGTLWAFVPSAL

SEQ ID NO: 7775 - protein, 326 aa, Lactobacillus casei
MADDKKKVLVSVKHLVQTFNAGKKDEVKAIQDISFDIYEGETLGLVGESGSGKTTTGRAIIRLYDPTSGEILYNGQDIAKLKNGSKQMLAFRRDTQMIFQDPYASLNPRMKVKDIIAEGIDIHHLAKDKADRDHQVEQLLEEVGLNADHATRYPHEFSGGQRQRIGIARALAVQPKFIIADEPISALDVSIQAQVVNLLKDIQDRQGLTYLFIAHDLSMVKYISDRIAVMHYGRLVELASADEVYSHPLHPYTKSLLSAIPVPDPDVERKRIPIPYDASKVEGDNKQRKMVEVYPDHYIFAADDEVAAYKAEAEEDHKTPAGTAAD

SEQ ID NO: 7776 - protein, 350 aa, Lactobacillus casei
MTKILEVKDLEIDFATYAGPVHAIRDVSFDLNKGETLAIVGESGSGKSVTVRTVMGLLAPNAKITHGEVLFDGVDILKKSEKQLNAMRGNDVAMIFQDPMTSLDPTMTIGKQVAEPLMLHNKISESDALKEAERVLELVGIKDAGGRLKDYPHQFSGGQRQRIVIAIAIINHPQILLADEPTTALDVTIQAQIIHLLKEIQSKIDTSIIFITHDLGVVAGIADRVAVMYAGKIVEYGAVDEIFYNAQHPYTWGLLEAMPTLETKSDRLYAIPGTPPDLLDPPKGDAFAPRNPYAMAIDLEQEPPFFKISPTHSAATWLLAPGAPKVELPPEIARRHALWASKHPNEKVVN

SEQ ID NO: 7777 - protein, 332 aa, Lactobacillus casei
MATTKLSPDAFKHVKVNTAEQERIAKPALTFSQDAMRRLKKNKAALISLWILIIIAVISILSLWLSPSNPNKQNLNYSNLPPKWPGVDLPGLNGYLNGQNKYAGMGKNVYYLLGTDYLGRDLLSRIMVGTRVSLFIGIVATFFDLTIGVFYGIISGWRGGMTDTLMQRVIEIISSVPNLVVVILMLQVFKPGMTSIILAIALTGWVTMARLIRAQTLQLKDQEFVLAARTLGESSVKIAFKHLIPNLSSIIIIQTMFTIPTAIFFEAFLSYIGIGLPAPTASLGTLLSDGQKNLQVLPYQLLYPAIVIVVLMLAFNLLADGLRDAFDPRSEH

SEQ ID NO: 7778 - protein, 307 aa, Lactobacillus casei
MAKYILKRIGFLLLTLFLVATITFFLMKLLPGTPFNNPKIPADQLAILKKQYGLDKPVWMQYLTYMAGITHGDFGMSYQYPGQTVSGLIVSRMGPSLQIGAQAMVVGTLAGIVLGAIAAIRKNTWVDATATIFAILGRSIPNFVFAALLQLFAYKTGAFPVALWGGFTYSILPTIALAIAPLAQTARFMRTEMVDVLSSDYIELARSKGESRWQVVAKHALRNSMIPIVTIIGPMAVDLMVGSLVVENIFAIPGIGEQFVKSITTNDYPVIMALAILYSAMLTVIILIVDILYGFIDPRIRLSGEAN

SEQ ID NO: 7779 - protein, 540 aa, Lactobacillus casei
MKFRKTMVAGTTIALAGVLAACGSNSASSNGKSITRMESDVISTMDPSTNTDVIGGQALIDTMDGLYRYSGNKLKPAIAKSEPTVTDGGKTYTFKLRNAKWSNGDPVTAQDFVFAWRRTVEPKTKSQYAYLYSGVKNADDITAGKKAPSTLGVQAVNKTTLKVTLEHPIPYLKTMLVNPAFFPQNQKFVEKAGKKYGTASKYLLSNGPYELKNWNGTGNTWKETKNKTYWNAKNVHIDTINGQVVKDSQTALNLYQSKKLDLATKISGQQAAQAKTMADYRGLKQNGTFYLELNEKKDPIFKNAKIRQAISLAINRKEYIKKVLNDSSIPAANATPEGLFTKNGQDFAKEAAKNDGSATKYDPAKAKQLWTEGLKETGQSAPTLELLTDDTTGAKRSAEYLQSAFQQALPGFKVNISTVPFKTRLSRAQNGQFDMVYSGWNADFPDAISFLDLFTTDNTYNDGKWSNAQYDALIKQSKTTDATNPTARWNTLLKAQEILTKEQGVVPLYQRVETTLQRKTISNLKYNPTGAYDFVNATVK

SEQ ID NO: 7780 - protein, 522 aa, Lactobacillus casei
MAKDQPFKLEATYAPASNRASSRSGLINCYKITMSIEYTRKGVGTMEMSRAQRIKILIVLGMMSLLTALSGSSTNLAMPRISEDLMISSSAATWIVSIGLITTAVLLVMFGHIGDLVSKNLVFLIGEVVFIVGSLLTGIAPTYLTIMAGRVVQAVGSAMIMANSMGIISQYFPDANRAEALAVISMFVSLGSISGPAFGGILITWASWRWIYLFNVPVGIMIVLAGMRLLPLRRPAHGEIRRVWQQANWTGQNLFTGGMILMFASGYWLQQPKQLWLGAGILAGGILLTILAFIQDQRSRSPWIAPSIMHNPDYLISVSVLLIVMLVNSVSNILLPFYLQSYGGISAFASGLLMMLQSVTMLMITPFAGWLADHWNRYYLTILGLFVLIISQIGYASYPAKITMAPIIWPIVANGAGMALFLSPNNALTMGAVDSSLSGVAGSMNSLARTIGLTIGISFGATLLFAQLPGVTRISPQSGEPFLHALATVFWLATLVSVVGLVIVVFRSIRSRKNGKTLTNNK

SEQ ID NO: 7781 - protein, 187 aa, Lactobacillus casei
MTEAIDLKAGMVFVKDGKLIKVLESNHHKPGKGNTVMQMKLYDVRSGANVTTTMRPSEKVEIAIMDRKKATYLYTQDDTAYFMDSDTYEQYEVPTASIARELKYMLPNVPVEIEFYGDEVIGLELPGTVELEVTDTQPAVKGGTVAGGGKPATLETGLVVTVPDFVKAGEKILVTTDTGTYKGRAQK

SEQ ID NO: 7782 - protein, 235 aa, Lactobacillus casei
MIDHSNREDFLNAIAEKAGRPRHQLQDHPFEPLNDLPETTLSGHSQDELEAIAKKNSEAVHVTFSTTDKAGLADALNAYIEHDAPKTLILPTTDQYEDFGLRDWTGTVVPKPMYWTPGKGRDFNLKQAAAADVAIGFADYLLAESGTITIATTPGQGRGFHFLPTHYLAIVKKSNILPRSRQAMDRYDAAIKAGELQTSNINFITGPSNSGDIEMTLVVGVHGPLDMTYLVVEDM

SEQ ID NO: 7783 - protein, 494 aa, Lactobacillus casei
MTISTSDKPFLERVKESEQDKFMQASVAKSQDAQWDKREASRKELGNWPQWRDLGEQIRQHVIKYLPDYLEEFSDNIEKRGGHVYFAKTDKEAAAYITKLAKEKQAHKIVKSKSMVTTEINLDKELLKIPGTQLMETDLAEFILQEDDWAEPTHIVFPALAKNRDQVKEIFDKLGYEGDNDPEHLARFAREYLRRYFLQADFGITGCNFAIADSGLINLVTNEGNADLTMAIPKTQVVVMGMERIVPSLKEAETLDNMLSRSAVGQKLTSYCSFSGKQVEGEADGPEDFHVVIVDNGRSNALGTPFEPVLQCIRCGACLNVCPVYRHIGGHGYGSIYPGPIGAVLSPVLDGYEKFGDLPFASSLCAACTETCPVRIPLHHLLIKHREVMMDKLKMDHSFSDKIMKMVGVGTSAPVLFNMALDMDHAMMGVLATKDQGSVENEYNSGRIKQTGMMPKLARGWTDVRDLPRSPKKNENFRHWFKQHKAALEAQKHD

SEQ ID NO: 7784 - protein, 260 aa, Lactobacillus casei
MRVVIFSTCIVDLFFPNVGAAMTEVLERFGCETFMPVKQICCGQPTYNSGYVKASQKVFRNEIDALLSVDADYIVGPAGSCVNMLREYRILLKDDPEYAEKAKQVADKTYEFSQFLYRVLNVIDAGAELDAKATYHRSCHMTRLLGERTAPFKLLDHVKDLQMEPLPHIENCCGFGGMFSAKEPEISKQMVDEKVDDVLSTGAQVLISADPSCLMNIAGRFSRRNEKIKIMHIAEVLNHNVNPERIKFHEPLGVEQEVRP

SEQ ID NO: 7785 - protein, 188 aa, Lactobacillus casei
MRKRYRATLRALNSDCIGRQAHGFANFEVTDDDALQIRIEMFNTPADMNHMAVLESTGSDAPVAPATSAQDQNHDGVVDEEEAEQVSGKVFVPLDNAPDKLKLVGSKYPEADDNGFYIYQQRVVVSALRDQLRKRYGRDVLNLDNTVIYVNGVQSDVILPKTVASDLDKSKPYLTLPIAVGKLRKVMG

SEQ ID NO: 7786 - protein, 110 aa, Lactobacillus casei
MNEVNEETIMGLIMAGGNAKSEAFEAIQAAKTGDFSEADHHLKLADEALVTAHNVQTELLTAEASGEHATVSLLMVHAQDHLMNAITFRDLAGEVVAVYQRLAEVTAVTD

SEQ ID NO: 7787 - protein, 366 aa, Lactobacillus casei
MGKLGISLYPEQTTVAQATAYLEAAQQFGYHRLFTSLLQLSGDHGRDQLAVFKAVVAKANQLGFQTIVDIAPPLFKELGIDYHDLSFFHDLGVWGLRLDEGFTGQEEALMTHNQYGLKIELNMSAGTNAIDAIMSFGPRRSNLLGCHNFYPQEYTGLGDERMVAYSQKFRQYGLRTAAFISAPSADHGPWPVSEGLPTLESDRHRSIASQVHHLRLTEVIDDVLIGNALASEADLKAAALAFFCPYPTLRMTTEPSLADLEAKIAFSEAHLYRGDASDYLIRDTQPRVRYAGQPLPAHDATGILHRGDVVVVNETYKRYAGELQIVLRDLPNDGRRNKIGQLTDEDLTLLPLLKPWRTFMLKRVAE

SEQ ID NO: 7788 - protein, 136 aa, Lactobacillus casei
MKIIMNLPVAPNVFFNQLQQSALADIRQHTGREPLPKSLRGYSYAKNWPNGRTARLTITEFEPNSVYAYELATPRDDFKVRYQLTPLESGKSRLVYEESLVAKSARGAANNRASGFLLGWFRKRRFKKMARQMCIT

SEQ ID NO: 7789 - protein, 54 aa, Lactobacillus casei
LKTATTALILINISMAIIVLSAFMPTPWRIGGCLLGVIATIFCTRWYVGLAKAK

SEQ ID NO: 7790 - protein, 475 aa, Lactobacillus casei
MNAFIGWLNRHIVPVAAKIGSIRWLVALRDAFIAIMPAMMAGAVSTVLNVLIRDIPTQFKWMGIVNSMQWLIGINAMVWTGTLAILGLLFAFTFGYHLAVQYQVEPVTGGIVVLGTFIMSLPQNFTLALKGTLGKSAAKLITDAGGVVDGKNVSMWGFFNFNKFFGSYGFFTVMIMGALAMTLYIWLMKKNVTIRMPESVPPAIAKAFTGIIPATAALYLAGVVNYLFSVNKTTVIEFIATIVQEPLLNMSQGFWAVLLMTLLVQIFWFFGLHGTNVLGPVLDSIWLTAQIANMNAFMKGEALPFVWTRNAFDLYAWIGGAGSTLLLLIAILMFSKRDDQRTVAKLSIAPGCFNVNEPVMFGLPIVLDPIYFIPFIAAPVVMVSIAYGAHMLGWVSPVKNQIVWSMPPFINSIIATMDWRAPILQAVNMVIGFLIYVPFVKAANKLDPELHMTEPPAEKNKETADDDRNLEGDAI

SEQ ID NO: 7791 - protein, 740 aa, Lactobacillus casei
MANIEYDPQRQLFHLHNATFSYIIQVIRGYLVKRYCGPALEQFSGTAKLEDFSHAFNIQNDAAPFSLTTLPLEYSTLMGGDYRTPAYAVRNAHGQLIGNLKFHDFQILAGNENFNGTLPTARTPHGQTLIITMHDETDTLAVHLKYTIVGDLPVLLKQVAYRNLSDNTLTITHAASLQLDFDDHAYDLITLTGAHLSEASVTRQPLTPGKKSIASNYGASGPQGVPATILAAPATDDFAGEALGVTLLWSGNFNYTAQVDQFGNSRLVMGLNPELFSWQLKPGKPFVTPEAAVAYTTKGLNDLSHIFHQFFANHVMPVPRQNLIEYNTWESTYFDVSEAKVLAEIPKAEALGVELIVVDDGWFKNRPNDAGQLGDWVPDPVKFPRGLRPVADALHARGLAFGLWVEPEMISENSELYAAHPDWAMQYVGQKPLRSRNQLVLDLSQRIVQDHLIAVLTDLVRTNHIDYLKWDYNRHFSQPGSPVLPPDQQGEVGYRYTRGLYRVLKTLRDTFPKLIIENCSSGGGRLDGGMLAYTDQTWTSDFTDPVYRMKIMNGFSLFFPLKTFVSHFTMSPNLQDSRVTPLRTRALLSLVGVTGIECPPSQLSPAEAAAVKASFAFYKANRAELQNGSLYRLHPSHPNQDQVCWLITDEAKTKAIVLTSAGVIAPIPHYQHVLLHYLRPTMSYQINDKKTATGAELNFAGVTLPLAHGDFSATLMTLQAVSHLPQTTTQANGDIAKLPF

SEQ ID NO: 7792 - protein, 247 aa, Lactobacillus casei
MKFIIAPAKKMVVAQDDFPVQSQPQFRDQAAMLLKRMQQLSQAEMQALWQTSDRLTQAAYQQLQRSDVTRQQSPATFSYVGIQYQYMAPDLLDDAGLAYIQQHLRILSGLYGILRPFDGIVPYRLEMQTRLVMPPYRHLYDFWGDRLYQALAAIPGPIINLASDEYAKTIRPYLQPDDTFIDVRFAHLVKGKLKTRATYAKIARGEMVRYAAMHQVSTVAELTQFDSPTYRYDPERSTETELVFVAK

SEQ ID NO: 7793 - protein, 854 aa, Lactobacillus casei
VEQAQVYENVDLQIIKLLFNSDSSDYKVYAVRILNSNPKLKMTLTQEVTVTGDMGYYNRRAIITADLVYDDADSLRYRKPSYKVARLHFGLPKEPRRQWQLIDTLLVHQPTVLRRLHDYFADDAPILTLFSKDEIKTAKIPGVGPATIQKIATAIRGKLEVAVLANHWGKALSSMTYEKIWLAYKDAELAMQHVDANPYVLMQVAQLDFKKVDAFAKSRGVAPNDPHRLAAGLQYIFRTAVLTQGLTYITITWFKEQAATLLGVSTDDLTMFADPKQALAYGFLLNEQYDLVTSCDMFATEGSVARIMAVAQKTAEPLIKPAELDEKLDKFLDRHQLVINDQQRAAFQNVNQHGLSVLNGSAGTGKTWLTNLLVHFFNAQAKGKSVLLAPTGRAAKVLARYTHEPAATIHAYLHLLPGEELDRFDSEADWETFGDARLIIVDESSMLTTPLAYTVLKNVNFKKSHVLFVGDVFQLPPIGPGNFLKDCLADEHVAATTLTRVYRQDSQSGVLALANRIRDRLALPFGPDDDRYVSGNVALYNQRDAGRVFDAGIKAYQEALAKHGHQPDSQLLIVNKNIGATGRLRFNAELQALVNPAKAGEPEYVSSYVDPVTNQKHHLRLNDRVMILKNDKHVALVDPKTWERRAVLGENGLQKTDEFGTKRWRETIMANGDTGVVAHIDPKRHFLVVQVGDQYCYYSFGSVPRALTLAYAITVHKAQGGQADTVIAIVNGADHMLNAQSFYTALTRTQSQFIFFGDFRVLLARTKIYPIDSRHDLLGSLLSGQLTVDTFSRFTFEQILAWLDHQRHQGIQPRAAVTAAKPEAATQPFSVRYAEQLDILNQVVEEVTKLPVKR

SEQ ID NO: 7794 - protein, 200 aa, Lactobacillus casei
MTEKHEQPDQTSPEHQQLIKLPNGVTAKGVLLQRGMVNLQKEAEQADFPAQTKAYLAWMNDLNGNRFGIKITDAADHELLRHTQFLDDAIKELAYADAPANAELTPDDYKPARNFYVPSAGLVALVAALQWAAQHERQDVVVYSTHRHDLTFYQPRHQATFLQQWAQQQLKTLPSDFRFRIATKLDRDATHETTKLRMQL

SEQ ID NO: 7795 - protein, 218 aa, Lactobacillus casei
  misc_feature (4)..(4): Xaa can be any naturally occurring amino acid
CAAXAMINTERMINALPRTEASESELFIMMNITYMMLAAAFILSSAVVIYITYRIVFKYTRRRMIQKVELRDIWYILGGYVITVIADEGLLALNDLIYHQSETPNSQMIRESFMDANWTVTVLLIVEIILIAPITEELIFRGVVFNLFFSPNRIVLRTLLSAGLFAAVHATDTVFGFLVYAFSGIVFATVYSKTGKLQNTIVLHVLNNIVGTLIILLF

SEQ ID NO: 7796 - protein, 73 aa, Lactobacillus casei
MLKINRSGFCNFLTGAARILDLLGTINRREWADRQGIKFEDTDDAINDAWETVGKLMAVQFGDSENEFCDELH

SEQ ID NO: 7797 - protein, 204 aa, Lactobacillus casei
MSKKRWISGITFAGLLVGSLTTGSVVLAADEDTGTTNTSVTVTGGTIGLSAPSALAFPGVTVESIVKGNLNDPVTTADSSLLTVSDFRGTGAGYTVSAKESPITNGSGATLKGAFVQMVPDTLVTPNAAAPAWTKSVDLATSDQPLFATGTGQDGGGITSYDLNKITLDVPEDNDVKAGNYSGVITFTLTPGQPAQAATSNPVP

SEQ ID NO: 7798 - protein, 270 aa, Lactobacillus casei
LKIIAIGDNVVDLYPADKKMFLGGHAANTAVFATMMGLEAAYLGTFGNDARGDFARRTLSELGVDISHSLQYDGPNAFTTMRLSDGKRQKTVGEPVQELQLSPDDIAYINTFDLVYLNNESGADAFLSAITAPKIYDFSTIDDDRVFKKIAPQIDLAYLSGKAKSDDDVEALCRRVAAAGCDQVVCSRGLRGSAALVKDTMSWQQALGVKAVDPLGAGDAYITSFAATLYSSAKPTLDAKVSESLSHATKFSSAQVRVPGSFGHGAALIA

SEQ ID NO: 7799 - protein, 435 aa, Lactobacillus casei
MGRQRWKVVSSPFLMVALLMGATSAPVAAAVPSSVTTTVSSAALASTQKPSSSVASSTATHSSASSSATASSTGTTNSTASSSSSALPNARTAVIKSIIAHRENTLAPGITEQMLTYLNRSNEQTKYYSVSLNPKNPQTQLVAGTAATTTNLPVQTVRDQANAVIQQGQPVVAAVNADFFKMATGIPTGNVVKNGVELHAATSASEAFFGVEKDGTPIIGNEHTYLLVKSQLQQALGGRNILVANGKVNDTKPMGTDHEPRTAVGIKADGTVFFVVIDGREAPTSNGISMADLANLMIQRGAVTALNLDGGGSATYVSREPGSTQLTVQNHPSDGHERAVANAWLIVSKTAPDNQTASGQVKSDNQASSSEKAATSSSQSSEASDSQTSSSSSSKKKGDTLPATGENDLATGILGLILVVASAATYLISGYRRTR

SEQ ID NO: 7800 - protein, 518 aa, Lactobacillus casei
MYRLGIDVGGTNTDAILLDDQHHVINSVKRHTTKDIQTGISNAIQAVLADQPLDRDQINKAMLGTTQITNAIVERKHIARVGVLRLAYPATEAIPPYTAWPEDLVNKLSGKYAIVKGGYEYDGQILNEIDPTEINAVLEQWRGEVDSIAIIGVFAALRVDQEQQAADLVHAAYGADFPVTLSHEVGSLGLIERENAAILNAGLFRVIENTVDGFEQALAASGIKHASLYLTQNDGTLMTAAYARHFPILTIGSGPTNSIRGAAYLSHLKNAIVVDIGGTTTDLGVLQAGFPRESSIAVTVGGVATNFRMPDIMSIGLGGGSIVRQQRDGSVTVGPDSVGYQITDKALTFGGNIITATDIAVRLGLSEVGDPELVKQIPLKFAQAALKTIGEMIAVAIDKMKTSAEPATVILVGGGAIIAPRHLDGVGKLVRDPLGGVANAIGASISQVSGEYGRIYPYNQIPRDQAMADAKKKAIAAAIESGADEATIEVVEVDEVPLAYHPENANRVKIKVVGNLAR

SEQ ID NO: 7801 - protein, 361 aa, Lactobacillus casei
MRLLDEESIENIATGAAFFGAGGGGNPFLGKLMALEAIKKNGPVKLLDVSEIDDDDYFCPAAIMGAPAVMMEKIPKGDEFERVFTMLSQYTGHRFVGTFPMEAGGVNSMVPIALAASLGIPLVDCDGMGRAFPELQMVTFYLGGVAATPMVITDEKGNAGVIKTIDAKWAERLARVQTVEMGGSATVALYPSSGAQIKQNGIRGIVTLCEQVGLRIRDAHLNPAKALAEILEVTNGHLIFEGKVIDVERRTERGFNVGDIKIDGFNDFQDQHLSVLIQNENLLALRNGKPLVMTPDLIEIVDADTLLPVTTEVIKYGKRVKVLATPADARWRTEAGIKTAGPRYFGFDYDYRPVEELVKEG

SEQ ID NO: 7802 - protein, 416 aa, Lactobacillus casei
MEENKRDQTWFGLAMILCGALVSIPSLILGGSLVSGMSLPAAILTGLAGYGFIVLMMVSQGMQSVDQGKQAVVVAQQVFGKVGSSKVISIIIAIAALGWFGIQANVGGLAVANLLKYLGLPIPAWLASLLTGLLMVVTAMYGVKLIRLLAYVAVPYLVIVILYGLWFAFAKQDAAAMIAAYHPSGAVSFVNGFSSTVGSFAMAGVIVGDYAQFSKKRSDVVKAAIFGVIPAGVLMIAVGAVLTIAFKSNDISSLFMKIGSPVIGGLALILGTWKVNVVNAYSGGIAVANIFNIPEKYRKLTLFLVGVGGTILSIIGILNYFEPVMNIFSAMIPPVAGAMAASYWVIHHGDLHSWQPVPGVNWLGLTAWALGAVVGVLPVVWPAVPNIPVLGIILAFVLYYVGAKLHPEWDKASELD

SEQ ID NO: 7803 - protein, 108 aa, Lactobacillus casei
MTVKTQRQGDSILIPVPATFNIGENVEYQPTIDKNGVITLIPIKRHIFDSNPDYDLRKDIKGENIGDNGPAVGRENMWHDRGCISDLIWISHELLRVLRRRSFNRPII

SEQ ID NO: 7804 - protein, 236 aa, Lactobacillus casei
MKAAKYKQIEADLLRRIQDDQYPIGTLIPKELDLVEMYSVSRPTVRQAIQELVNKGYLEKKKRRGTLVKQKKIAQEFTHRLQSYSQEMGEKGLQPETRVLNLTEETANEEVQKHLEIEKGQKVYKLVRLRYANEEPIVFVTSYIPVDVNSEFLKTDFETTSLYSLLKKSGYAVTRVRRKLEVAVADETIGDMLNVSEGAPIFYFHTQGITDKNRIVEYSISKYRGDLNYFVIDIDQ

SEQ ID NO: 7805 - protein, 239 aa, Lactobacillus casei
MKDYTLDDFARMIDHTNLHADATREDMRKLCDEAKHYHFKMVAINQTQSKFCSDLLMGTDIDTGAAISFPLGQTTIESKLFDVKDAINNGANEIDYVINITELKAKNYHYIEDEMSQIVTICHNHNVPCKVIFENAYLTKEEIKKVAEIAKKVKPDFIKTSTGFGPSGAKVEDVKLMKSVVGNRVSVKAAGGIRDAGAFLSMIEAGADRIGTSAGVKIIEELRERIAKSDAQFISLQRN

SEQ ID NO: 7806 - protein, 149 aa, Lactobacillus casei
EIIABCMPNENTLIILITSHANLADGLVSAFEMIAGHKNYIQALSLNTSGVNEFRRRLLAFLNNAPSPVLILADVKGGTPYNEAYKYYLAHSNKCSLVSGVNLPMLLEIGTNIENCTDLDDVKAKTKAIGQQGIEIAEDIVEDNDDLDF

SEQ ID NO: 7807 - protein, 164 aa, Lactobacillus casei
MTISVVRVDDRVIHGQTMTRWTKARPVDGILVVGDNIATDTLRRKVLKAAANDLKVGIYTVAEAPTKIKKGIESKKRFFLISDSPQTFSKLADMGVEFGSVLNVGPMNTRAGAKVLGRTVAIDQADYNAFENLEKHGIDVQFQLLPDDEIKRWKTMKAKYDEMS

SEQ ID NO: 7808 - protein, 287 aa, Lactobacillus casei
MNTSLFISAMLTGIFCYLGAIESPWLFGMSGGFYIVGRPLVAGLLVGLAFGDVKSGILCGLAVQAVFIANLSTGGATNSEITYAAYGGIGLAMATTRNPAIAVTLAILIGQTFGLIFYNGRMALYSFWNARADKAAEENNDRGIVLNHLIYPQITTFLLRAVPVFFAIYSGKGLVNWLIQSIPDIVTHIIQVLGGVLPALGIAMLMAIVIKSNAHLIFFFAGFVLLAFAKLSMIAIVFIAALVAYMYYLSSNNHGAKGVKTSETSKDDGSHEATVNTDTEYEDEDLF

SEQ ID NO: 7809 - protein, 278 aa, Lactobacillus casei
MPKSTQSTSGDTMLSKHELNQIWYRWGFTHLSSMSYEKLQAHAWAYSYIPFADKYYKDDEDGKRRLLVRHSMFYNTEPQTGQLINGIVASLEEQIAMGRNVSEEMPVNIKATLMGPLAGIGDSIIQGIIVPILLSIAMSLAKGGSPLGPMFYIIAYGIIGPTISYIAFHSGYRLGVNAIDVIVGENSKRITDAFNILGIMVVGALAANTIVLKTIAKIPLGGKSAPLENVLTGIFPDLLPLAMVMFAWWLISAKQMSATKVILIITAIVTVGCLVGFF

SEQ ID NO: 7810 - protein, 301 aa, Lactobacillus casei
LYLLKSLSKDRIWGTPRLLPYGATSDHTGSVYSVAGISYLDCMIVDAATGIATSFFLATQQNPQKFGLIPGEVYPLIIDMLGADANLSIQVHPTDSYARDKGYLYGKSESWYFIQQPLDQHVYSGLSDTSMLNEITSYPSLTEQIAGCESVTTGDYLFVPAGTLHAITAGSLVYEIQQATDVTYRLYDYGRKGLDGKPRKLDVSDGLSTLNPEQTVQKQPFTINQSIQERAYQLRLIKLVHDLVVTNFSAIASALTLIKGTATADHHTLHLGQSLLLLPNESVNLEGNGELIQATPNPYWR

SEQ ID NO: 7811 - protein, 306 aa, Lactobacillus casei
MILTARVGANAGNLYIYSGKAKITDNTVFLVTDTPSFLKALLDHFDLKKIKFGTGQPLIKASELKRLKLFVPCDPTELDSIQDCVLNINNLIAATQGKLDQLEMVKKALLQHLFDQSMRFKGYSDPWEKRKLGDLGQVAMNKRIYKDQTSSTGDVPFYKIGTFGKEADSFISRELFEKYKKMYPFPEAGDILISASGSIGRKLVYDGEDAYFQDSNIIWIKHDERLANSFLNQFLSIVHWNGTEGTTIKRLYNKNVLTTKINIPSRKEQDTIGSCLTIFDNLIAATQSKLSGLESLKKALLQGLFI

SEQ ID NO: 7812 - protein, 308 aa, Lactobacillus casei
MKQRTQKFHMYFKQWIELYKEGAVRPVTYQKYQMSHKHLVTLAPDLHMDELKRRTYQELINEFAANHEKQTTLDFHHHLKAAILDGLDEGLLEQDPTRKVVIKGTVSRIHKVKFLNQHELTKLLALLDLDGGLGWDYFLLLIAKTGLRFGEALGVTPADFDMAKLTLTINKTWDYKSATGSFAETKNTASVRKVPLDWQVAMQFATLIKHLPQDQPIFVAAGQRVYNETANDILERKCKRARIPVISIHGLRHTHASLLLYAGVSVGSVARRLGHANMSTTQKTYLHIIQELENQDNDKIMRYLTSLM

SEQ ID NO: 7813 - protein, 221 aa, Lactobacillus casei
MRRERRKKSHWKTVGIVIVLLTIIGASFYVGSRYATSIQNQSQISRASSQSSTKSSQQSKQSKPESFTTSSPSKASQQQVQDQDPVSLAHSYIIGKGFSIVPELYDGEDVNQAMTENKAPQNSVHDGVLYGYFKDANTARLTGLGAYVGSYSANYTVDNHNIVLKLSNSAVPTKVIPYTLNVDGTVLLKAFSTDFEGHTLTSKVNFDEQARAYVDQKQAQN

SEQ ID NO: 7814 - protein, 405 aa, Lactobacillus casei
MSKDANNVPALRFKGFSDAWEKRKLGDVTKLITKGTTPRKQNGQGTINFIKVENISKGGNISVTNKISFEEHQGYLARSVLQENDILFSIAGSLGRTAIISKSLLPANTNQALAIIRLGSGDVKFVATYLSGTAVNEYIKRNPTTGAQPNISLTQVASLHIDWPCLDEQRTIAKLFSKVNNLIAATQGKLDQLQMVKKALLQHFFDQSMRFKGYSDPWEKCKLGDIAEKVTEKNKSGEFKEVLTNSAENGIVSQRDFFDKDIANKESLSGYYVVRPDDFVYNPRISNSAPVGPIKRNRLKRIGIMSPLYFVFRVHGVNHGFLEQYFLANVWHRFMTRNGDTGARSDRFAIKDSVFVTMPILIPSVAEQQHIASSLQTLDGLIAAAQSKLVGYRQLKKSLLQELFV

SEQ ID NO: 7815 - protein, 536 aa, Lactobacillus casei
LDNTHNTQAQQQAELQKRLWSIANDLRGNMDASEYRNYILGLIFYRFLSDQVSDEGEELFKNDPVDFETAYQNPDDQEDIKQAVIEYIGFFIEPKYLFDSLIKDIKAGNFDTEKLQNAINEVQLSTVGHESENDFRGLFADMDLGSNKLGATVSERGKMIAKVMLALADINFRSQDMQIDVLGDAYEYLIGQFAASAGKKAGEFYTPQQVSKILAQIVTLHKHELRSVYDPTMGSGSLLLQVGNYVDRIGEYYGQELNTTTYNLARMNLLMHGVNFSQFQLFQGDTLENDKVGDKQFDAVVANPPYSANWDPTDKIDDERFRKYGRTAPKSKADFAFVEHMLYHLNETGIMGVVLPHGVLFRGAAEGAIRQFMLEQDNVLDAVIGLPANLFYGTSIPTVILIFKKDRDARNVHDVLFIDASKDFEKGKNQNSITDDQIKRIVETYDKRKDVDKYAHVASFDEIKENEFNLNIPRYVDTTEPEKPVDVVKVVANIKKADEQIAELSQALAKDFDDLVANNDEAAKQLTALKELFKNE

SEQ ID NO: 7816 - protein, 957 aa, Lactobacillus casei
MAVGYQSEAELENQLIRRLEGLGYRKISIPDVKTLDQHFRDVLNQRNSENLKGKSLSDREFTAALNALIGARTHYQIAEILRGSDIQPYGKIEIQRDDNSKVFLQLFDGTDPKNNIFEVTHQMTIYGRHENRYDVLILINGLPVTQFELKRRGVDFSEAFNQIIRYRSESEKYARLLSLIQMYVISNGSETRYFANGDGQLNSNFMFYWTDKENNWLNDIDAFTASFFDQARFHSLIARYTIFDRVEQKMMIMRPYQIYAAEAILDHAQKDSHKNGYVWHTTGSGKTITSFKASQLLARLTKAEKVIFLIDRADLDEQTARNFAAYLPADVNGQSALDRTNNTRELVRQLVSNDSPLIVSTIQKLNNAVQNNKYKKELTPYHDRKVVFIEDEAHRSQFGDMRKNVNRWFQNSQHFGFTGTPIFKENTGIDGRTTADLYDQLLHKYLIKDAIRDHNVLGFTVQYIQTFQGKSIVNDDGELVKGIDQASVFEAPERMANIVNHIINKHAQFTKLKHYNAIFTVPSTRQALAYYDLFKRLDTNHRLNVTTIFTWQANEVDNEAHQGQDDVTSRQGLDKVIEDYNKRYHTDFSTDHFSDYFKDVSKRMKAHNDATPEENIDVLIVVNMFLTGFDSKRLSTLYVDKKLRWQGLIQAFSRTNRIDTNNKPFGNIVCYRNLKRATDDAVALYSDGDQQAFFAPPYPELKNQFIKAIQALQVVTPTKDDVDPLYNQGDEALEKFVLAFRSVLRIYNKVRVYDEFDWEQFKNIFTNQDFEDFKGKYYTAYKRLKPDNPGEKADILDDIDFDMTLVQTDTIDVTYIVNLIKSINLDDDKSRNSDIAKIQRFLNNATDDHLKSKAELLKRFLDENVPKLNAKSDIGNELDKFLADSRENALVGFSKNHNLPISVVKDQLSDYNFTGRANLQSMQKEFNDLGFGFREKRKLSAEMQQLLENVSEKYSLS

SEQ ID NO: 7817 - protein, 998 aa, Lactobacillus casei
LQIRFDELKYQNDAVNAAVDLFKGQALRSNNHLFGKPGFQSSLFAKDGVGIGNNISVSKERLLKNLQQIQIRNGIAPDDKLVGENKRFPQFNIEMETGTGKTFVYLKTILELNKQYGYLKFIVVVPSVAIREGVIKSIQMTRGYFSGQYDGEVYEAFVYSSSDLNRIREFAIANTLQIMITTIQAFNKDSNVMNQQRDQLDGERPIDFLAETRPILIVDEPQSVDATDLAKKAINSLNPSVAFCYSATHKENYSTIYRLGPVEAYDQQLVKQVEVAALQNDEDGNRAYLRLISVANRKGRISARIEVYKKTKEGADKKVITVQQNSDIVSKTKLQIYSRVGFVTDIDTTPGLEAVYFTGEPRKLTLSYSDEEDEAVKREQIKQTIREHLEKELRFQKAQIPVKVLSLFFLDKVENYRKYDENGKYHRGRYAHMFEDEYRKLIKSSRYQGLRDASVPVNEVHDGYFSRDGKNHFKNTRGNTMADESTYSMIMRDKEGLLTSYDPGKGNTDSVNKLRFIFSHSALREGWDNPNIFQICTLVDTQDTMTKRQKIGRGLRIAVDQDGHRVPGFEINTLTIMANESYKNFAETLQTEYADAGVKFGIFTDDVFAAVVTSVDDDTGEQKPLGKGLSRRLIQSLIASGYLTAERKATNKLVLALQSQSIVLPNEFSEYQDQILAIATKYVKSLQIYNRADRKLVSINKGQPSEDFKGLWDRIKSKTTYRVNFDTDKLIDHSVRKLQNITTHQGNFTYTKAQIVNTIAGFEVQNPHGRYTSNNDMLPYELPDILTFLQNETHLTRRTLAKILRQVDDLTAFQTNPQSCITQAAKLINWEKQQLMVAGIEYKENGAVFEQSLFSTETLYAYLDHGDLRGNAVKVSSNKTIYNYIVTDSETEKQFARDCEQDDNVLFYIKMPAWFKVPTPLGTYNPDWAVIYKREDGVRLYFVADTKANPDEEALRGHELLQIKSGRAHFRSLKTGIIFDVIKNEKSLLSLIQNFKTD

SEQ ID NO: 7818 - protein, 642 aa, Lactobacillus casei
MDNSKMPFKKVEGTSVNLIKQNIESLRKLFPEIASDGKIDFNQLRVLLGDSVDDSEEKYKFTWHGKQAAMRLAQRMSTATLRPQREKSLLWDKTKNLYIEGDNLESLKLLQKSYSGKIKFIYIDPPYNTSHDFVYHDDFRDSIQNYLEITGQVDQEGNRLSTNLETSGRFHSDWLSMMYPRLQLARNLLREDGVIAMSIDDGELENLRKISKEIFGENNFLGQITYLNNPKGRSQDKYLATSSEYILLFSKTVLPSGAISISKGHHKIDKQYPYKDQAGQYRLIELRNTHREFGKYNRPNLYYPIYIDRDGKVLEEEDNKSIAVLPIWNDGFEGCWTWGKDKFLKEKNLLIAKKQQENWKIYRKDYVKQDGQTLTKVQTLLTDKAFHTEKGQAVLNSLFGSTDKIFQSPKSVDLLQLLVEMGTDRHGIVMDFFSGSATMAQAVLQQNIKDGGDRRFIMIQLPEKTPEDSVARTNGFKTITDIGEERIRRVRDELRASDSNRSIDAGFRVFRLDTSNLVQWDDLKRNQLLLLDENFKADRSSEDILFEIILKQGLDLNSSVISREIEGATIYSVSGGSVYIVLGDQSIKSTVADEIANLYVKSKMEHSTVIFQDSGFASDSEKLNSIKILNDAGFQYANIKSI

SEQ ID NO: 7819 - protein, 268 aa, Lactobacillus casei
MAQIDAINQVINLVSLVVLLFAIVKTYRQVRSLNLLDYIIMYLKYRQTIYEEMQKNPQIRQKQLLSIAVTLLIATFWVISSLQHLMAQWNFSNLLNAITTLGLLGLFLFQTWQTKHLNEDNRYLTFANHYQRRHFDDVLRIFQKKLDEWTPQDDADQREKDRFHELLERVKAEAEHNRRAAMFSDDLYALFDDKLLLHDGSEPLTFREKGILSYYVGYWDAGPYNDYTLGMLEDMDERERRIASRVVNVSMGLMAAGLIWVAVRQVVG

SEQ ID NO: 7820 - protein, 398 aa, Lactobacillus casei
LTKQTHHIVIPDAIMDDLDIKDGEQVEVTLKDKEAVIRPKRADTGTQTISLRFFLIPTVLAGIVFLAYFFYFNILQVPMTGKNSIAQMVIVLGELSGMGTFAVTYIRNHRQIHGRDHRRRYWRIFPTLLLSFAIILAFVASVFFWAIGYMFEGVSFDIYTATGLFLIFISIVNYLMIYSALSISTSFITTLFLSTFVGGVVGAIVTNSSRQWWQHNVSFLGTSKALNAWQFNLTIAVSALLWIALVDYLFVPLMAHRKNDWRLITLRILLTVAAIALLGVGLFPNNRGILHVLHTQSAWFLNYFLIGMIIAVRWLLPGVSREFLSTSYTIGGIIVLAAILFQFVHYLSLTAFEMIAFALAMSWIMLLLQNIHRLYQKDESTFVVTVTSGKEKSPKKSA

SEQ ID NO: 7821 - protein, 910 aa, Lactobacillus casei
MRNIGKLVALDWKRIVKSPFAFLLIAALVIIPSLYCWFNVWALWDPYSNTQDLTVAVYSADQPATFRDQKIAVGDELMDQLKHNKQLGWRFVDSKKAVQEGVKSGKYYAGVVVPKHFSTDLLSFVDGKIHKPKLDYYVNEKINAIAPKITSTGASTLQNTISDEFGATVAKTLVKTFNKAGIKLDQNLPMIRRFASLVTNTNEQLPTIEKYLTEVDDLQGKMPAIRAKLQTANEIAGYLPEVNQMAQKLTAANGYLPMVQDAGELATAVKGKLPEVQQAGAQLNTVVTNFDQLESGVSQAVKVTDQGITVINQVDGTLPALTDFGQKAQAAVGTTKDEVLPKISTALDVVQNATDAGLTLIAAANTSLSADLTTLQNQLQQLDNSQDTAAVKQAMVERLTALAKRQGKVADNATSLAEMLERVQASLNKLTSQDDQVLAGAIAQLKEVAATATAVKDSAEALAKGVPNLSTSEIQARLEALAKTADQFAAAAAALKALDISTSVKQVLNDFKAALGDASTTLATINNQILPELPSLLSGTKDLLTQAHSFLVKAQQQLPALKQELTDANTLLNGHMNLITSGVTTVADLYQNDFPSLEAKLTKATDFINQDLPGIEKDLTNTLALANEKMPQLQSGLDDAHTFIKNDWPTLKDAIQKGAAAIKKGEKSVDLSQLIKLLRRDATKEAGFLAKPVELKQQSFYAIPTYGSQSAPFYLALCIWVGALLLGAILITEYQLPATLSDATVKQMYVARWLTFVGLGMLQGLIAALGNLFLIGTYVVDKPLYLLFSMMLSVVFVSILYMLISLFGNIGKGIGIIILVLSISGAGGNFPVVLSGKFFQMINPWLPFTYAVNLLRETVGGIYWPNLWLDLAVLAAFGISFFLLGLFLKEPIHPWIEKMHSITRRSKIIE

SEQ ID NO: 7822 - protein, 191 aa, Lactobacillus casei
MKLGFYKNGGLKGAIRFLILFTVALVLGGPLVTAGSAVYASEDTLDITKEEIDQATDNLSTILAEAYSTDPNMSEETVAQNVMLYSFSEAPDTSERTKRSLSSFSQCMVIKMGLGELRDVAKMVFNEQVVRYLKSQAWKKASAMIVQRITRFAGKKIASFAVKRLAHFALPGIGWGSLAIMGAQCGWAEIH

SEQ ID NO: 7823 - protein, 101 aa, Lactobacillus casei
VPRNKLSKNKKGSVIVSLLLTNIVALILIGLEFGYYDFGPYFIGAVSFEHALKGFLRTEIVLGGGFLILFNGYVIIWNLFLKKKERSSENKRSTKHTNRKK

SEQ ID NO: 7824 - protein, 667 aa, Lactobacillus casei
EIIBCACMPNENTMAKNYEQEAKAILKLVGESNIDSVTHCQTRLRFVVKDRKAIDDKALEKLPEVKGVFYGSGQYQVIIGTGVVNDVYAAIAKLGTVNAIYGKDDADTTAAATGEHKTLVQRLMAMLSGIFIPIIPVIAATGLFLGLKSAATNAQVLKLFGAVPSDIPASLTSVISVLTDTVFAFLPALIVWSTFRYFKGTPIIGIVIGLMLVSPILPNAYSVADGSAKAIMLFGWLPVEGSQGSVLTALVAGFIGAKLELFFRRHMPNVLEQILTPFLTMLVTFAIMILGVGPIVHAIESGMLVGVEAVIHLPFGIGGFLIGAAYPLMVLIGIHQTMIAIETSLLASTGLNPLITLEAMYGFANLGVALAIFLRARSSKAKATSMGAFTSQLFGVSEPTLFGVLIRYNFRPLIVTVLTSGIGAAILSMLNVAANSYGLAVVPSYLMYIYNGHALLWYTVVSLGTVVVAFVATNAFAIPKEVLKPDENVETANALISSTVSDDKVYAPVSGETVALAKVSDPVFASGMMGDGLAIQPAEKGVNNVYAPQTGTLSVVADTGHAYGMTTDDGMEILVHLGIDTVNLKGAPFTVAVKAGQYVNKGDLLGTFDQAAIKKAGLDPTTIVLITNSKSYARIEPVADTTVQAGADLLAVQREDVKVESVSPASL

SEQ ID NO: 7825 - protein, 554 aa, Lactobacillus casei
VTNPTSRTWWQQEIFYQIYPASFKDSNDDGIGDLPGIIEELPKLKELGVTAIWLSPIYKSPMVDNGYDISDYQAINPQFGTMADFDRLMATAKALGIKVVMDLVVNHTSDQHPWFQAALKDPNSPYRQFYIFRQGHDGQPPNNWRSNFGAGSAWTALPGEPNTYYLHVFSPQQPDLNWENPKLRQAIYQMINWWLAKGLAGFRIDAITFIKKDQDFAALTPDGSDGLGKVKRKAENRPGLGRFLKELNAATFGPANAVTIGEASGVAYDQLADFIGPNGYFSMIFDFHYADIDVASGSEWFKQTDWTPKMLGDAITKSQLAIQKVGWGANFLENHDQPRSLSKYIKDPAYRNAIGAKALALLYFCLRGCPFIYQGQELGMVNATRTSIDQFDDLPTHDNYQRALTEGYSQAEALACVNRRSRDNARTPYPWNNQANGGFSTHQPWLPIAQQAPGVNWQDEHADPNSVWHFYQKLCRLRNDSPLRPDLIEGDYAPIKVADDHVIAYARGQHVQVFVNLSAQTAKIDLPAGRIWLNNYPDATPTLQPYQAILIEVN

SEQ ID NO: 7826 - protein, 333 aa, Lactobacillus casei
MATIREIATAAGVGVTTVSRYLNHHPYISADKKARIEAAIQTLGYTPSAAATSLRAQATGNIGVLVSRVTNPFFAGLFDAIERTLHEQGYQVMISQTYDDPDAEERFLDQLKSRKLDGIILASVEAPERVAAVAKAFPGRVVVVNADVQIPHATSLVLPHYQATRDALDYLYEKGHRRFAYVTGGAIQSARHGKTRTQAFFDFMAANKLAVDPVLLFDHVHTAAEGQVIGKQLAALAPVKRPDAIFTNSDEVAVGVLDSLLAADLKVPDDIAVMGYDDQPFAPFARVPLTTVHQPVTEMAQVATDMLLHGLGRVDHQKDPATLALSLKIRQSA

SEQ ID NO: 7827 - protein, 492 aa, Lactobacillus casei
MTDSIEHMAKRYQPYSAWTPEYVASLKAQVAASKWRTKTHVQPDTGLINDPCSLNFFNGKWHLYYQQFPFGPVHGLKSWAHVVSKDLFNWRRVPGDLLPEDEHDAQGAYTGSALVTHGTLRIMYTGNVRDEQWHRHATQLGAVLGADSRLFKDPKPLIAAPPAGYTQEFRDPFLFKYQDKTYVLVGGQRADHTGAILLYEKLTDKTWRFVAPLSIPDEFCGYMVECPNIAFINGKVVLVYCPQGLDQDFFEYENVYPNIALVGDSFDPETGTLTHQRLQNIDKGFDFYATRLANTEKDGTLAISWLGLPDTSYPTDDDGWEGVLSYVRKLDLRDGHVCLVPHPNVETLRETADDSLPTVTKTDDNWSVADLTGAFELTMTLAAGQKTTLHIPDGDHDQLLINLDSDSGQGMVQRENRNNGGSLRQFGFPAGKNVTIRLFIDVSVFELFIDDGYRVVSGRFFGDTCPSAVRVTPAAAVSAVQAWNLRKDNGGL

SEQ ID NO: 7828 - protein, 393 aa, Lactobacillus casei
MLEKKFYHTMFSQSFNIPVRVEYWDHTEETFGTGEPTITIKMKKAIPVRQLIKNASLALGEGYMRGDIEVLGSNRPLQRLIASAYANAGSFMRSSKLRHFLPKQSHTERKSKEDIHSHYDLGNDFYKLWLDPTLTYSCAYFENWDDDLETAQLNKIDHILRKLNPQPGRTLLDIGCGWGTLMLRAAKIYHLHVVGITLSKEQFKLVSDRIEAEHLTDVAEVLYMDYRELDREPFDYITSVGMFEHVGKENLEGYFKDVAKLLKNDGVALIHGITRQQGGASNAWIDKYIFPDGYIPGMTENLGHIIDAGMQLDDLEPLRRHYQRTLEIWDTNFNNHRNPIQQKFGYEFTRMWDVYLQAAAASFEAGNIDVMQYLISKGPSGKDLPATRDYMYD

SEQ ID NO: 7829 - protein, 257 aa, Lactobacillus casei
MPKKETSAYATVQAARAPRPYQTRELINGLVTNFHEFHGDRQSHDDPAVIGGIGWLDQQAVTVIATDKGNDLTERLQTHFGSPEPWGYRKALRLMKQAAKFHRPIVTLINTPGAYPGKEAEANGQGAAIADLLVACADLPTPILAILVGEGGSGGALALAFGDEVWMTDKSMYSILSPEGFAAILWKDASRAKEAAEVMQLTPQDLLAKGVCDRIVPDTGADFPAALKAAVKPKLAELTAMDPQSLVAKRQARFRQF

SEQ ID NO: 7830 - protein, 270 aa, Lactobacillus casei
MFQPQLTQEALAREAALPENLWIQCPYCKQGSYRESLGDAQVCPHCHYGFRITAKKRLALVATETTEWDADLVTTDPLDFPGYDKKLAAGRQATGLKDSVWTGQANIGGQVCGLGIMDPKFMMGSLGTVTGERLTRLFEKATEANLPVVLYCASGGARMQEGIHSLMQMAKVSAAVKNHSNAGLLYISVLTDPTMGGVTASFAMQGDITLAEPHSLIGFAGRRVIEQTINQKLPQNFQRAETLLQSGFIDAIVQRSEQEAYVGELLAMHQ

SEQ ID NO: 7831 - protein, 460 aa, Lactobacillus casei
VFKKVLVANRGEIAVRIIQTLREMGITSVAVFSNADRHSLHVSLADEAICIGGPRATDSYLNMRNVVSAAILSGAEAVHPGFGFLSENAEFAKLVTDAGLAFIGPKPTAIEQMGDKAVARQTMIDLGVPVIPGSRPLQDVDTALAAAQAIGYPLMLKASAGGGGKGIRKLTDADALTAEFAGAQAEAQAAFGDPTMYLEKVIVPAKHVEVQVLRDQQGHVSVFPERDCSLQRHSQKMIEESPCPVLNSTERSKLLQLAETIANGVDYLNAGTIEFLMDKQHHFYFMEMNTRIQVEHPITEMVTGVDLVRAQLQIAAGENVELTTPEPSGVAIECRLNAEDPDHQFMPDVGTLNQLRFPTGGLGLRVDTGVAPGDKISPYYDAMIAKIIVHGQTRQEALAKMHRALTELDVQGVKTNRDFALALFQAPVVLAGKADTAYLNRDFLPQWQDERKDAACSNHN

SEQ ID NO: 7832 - protein, 146 aa, Lactobacillus casei
MLETKKTLEAQEIQQILPHRYPMLMIDRVLDLKPGESVVAQKNVSINEQIFQGHFPGNPIFPGVLQIEAMAQAGAIALLSMPDFKGKTAYLGGIKKAKFRHMVRPGDVLRIEVTLEKLIDHAGLGKGKVYVGEDMACSAELVFAIG

SEQ ID NO: 7833 - protein, 145 aa, Lactobacillus casei
MDTKMIESLIKQLEQSSLNELELTLGEDSLHLVKAGPVAPAPVAPASNPVPATPVNPTPAAQPEQPAGTAIKAPLVGIVYLAPKPGADPYVKVGDHVKKGEVVCIIESMKMMNEIKSTVSGTLKAVEVDNESLVEYDQPLFTVEE

SEQ ID NO: 7834 - protein, 406 aa, Lactobacillus casei
LQRVVVTGMGTVNPLGHSVAETVATMDAGKVGIQPITKFDAEKTGITVAGEVKDFKPEARMQKRLSKRMDLFTQYGLYSAIEAYEQSGLTKDNVDADRMAVIFGSGIGGLTTIQEQVTKMYVKGPDRVSPLFVPEAISNMVAGTISQYFGAHGPSYVVVTACASATNAIGEAAMRIQTGNVDVAITGGAEASVNEIGIAGFAALTALSKSTDPTKASLPFSADRNGFVLGEGGGALILESLEHAQQRGAKILGEIVGYGSTSDAYHMTAPDPSGTQASRAMQLAVEEAGIKPSEVGYINAHGTATKANDAMESKAIHDLFGDNVLVSSTKALTGHLLGAAGAIEAIMTLSALQDGRLPMNVVDAAQDEDCPVTLVNQDNRDTTVDYALSNSFGFGGHNAVLAFKRW

SEQ ID NO: 7835 - protein, 242 aa, Lactobacillus casei
LKLTDKTAIITGASRGIGEAIARNFAQAGANLVLNARHEFPETLIKELEGFGHGVVTVLGSVDDPTTGEQLVAAALDQFGSVDILVNNAGINDDMLAMRMKPATFAKVVQVNLDGTFYVTQPAFKKMMKARAGVIVNLASVVGLTGNIGQANYAASKAGIIGLTKTLAREGAMRGVRVNAIAPGMIATDMTAALSQSSQDQILAEIPLKRFGQPEEIAHTARFLVENAYITGQTLTVAGGLG

SEQ ID NO: 7836 - protein, 307 aa, Lactobacillus casei
LQFAYVFNGQGAEVPGMGIDFYQNTLIFKEIIDRADAVLDFDLPEFLANGDFAAHPDDLQPALVAYSVAMHEVASAELPPETALAGLSLGEYSALIAGGGLSLEDGLKLVAARGKAMAAACQNQPGGMLAVMSADQTVIQEACEQAPDVWPANYNGPKQTVLSGTHDALAVVEKWLKAQGVRAIPLHVAGGFHSPLMASAQPQLQAALKQANVFEPVIPVISTTALKPFTARNMRSVLAAQVAEPTKFATVIAQLKAEGVDTIVELGPKPVLSKMIKRIDRKMTTHLISDAASLNEVADLNNGVKAD

SEQ ID NO: 7837 - protein, 329 aa, Lactobacillus casei
MSPLMERLGVKYPLFQGGMAWVADGKLAASVSEAGGLGIIGSGHAPASWVKEQIEVAKSMTDKAFGVNVMLLSPFVEQVIDVIVDAKVALVTTGAGDPSRYLERLQQNGTVVMPVVPSVAMAKRMARDGVDGVIAEGMESGGHIGSITTMALVPQVVDAVDIPVVAAGGIGDGRGVAAALSLGAIGVQMGTRFLTSTSSRIHQNYKNAVIKAKDVDTLVTGMYVGHAARVLKNPMSRNYLKLEKEIALSGTTDFTAVEELGNGSLRKAVLEGDRDHGSFMAGQISGLVKREESSQDIVEEVMQQAKEILAGSKMADLLTSSTADAFPRQ

SEQ ID NO: 7838 - protein, 79 aa, Lactobacillus casei
MTNEEVLPKVQNIIADQLDKNAEDVTLTTNFKNDLDADSLDIFEIINEIEDEFDVKIETDESIETVADLVNFITERTEA

SEQ ID NO: 7839 - protein, 319 aa, Lactobacillus casei
LEILASAYSVPATRVENEQLRQFMDTSDSWIRERTGIKTRHVVTDQRNFDLAYDVAQQLLAKSATTADQLDFIIVATMSPDYATPAEANRLQAALNADHAFAFNLNVACAGFEYALHVADRLMTSPTVHQGLVIGSEVLSRLVDWHDRRTAVLFADGAGGVLISDQGAPVQAVDLKSFGDTEMVLSAGAQGNQSPFADATEEPSAYFKMNGRAVYQFAISEVPRSIQRALDQAAMTTDDIDWFLLHQANARIVQSVNKKLKVTADKFPINIDEYGNTSAASVPILLAQLAESGRLKRGQKLVLSGFGGGLSVGSLIMTY

SEQ ID NO: 7840 - protein, 149 aa, Lactobacillus casei
MSQKPSVKRINDKLIRVYSDILRMEEEELRKSQFRDLGIKEMHTIDAIGIHATPSSSDVAKKLHVTQGTLSVAINNLARKGYVERLHLESDKRVVNLRLSRKGRLMYRAHLAFHQKMVASFVKGFTEPQIELIERALDNLNEFIDEYRH

SEQ ID NO: 7841 - protein, 145 aa, Lactobacillus casei
MTTLDTSTIQTLIPNRYPLFYIDRVTELVPDESIVAEKYVSVAEDHLVAYLPGELTMPPTLIIETLAQAASILILKSPKFAGKTAYLASIGKTEFLKPVPTGSVLTLAVKMGKVRANMGVVTTTASIGDELVCHAELHFVVEANA

SEQ ID NO: 7842 - protein, 322 aa, Lactobacillus casei
VTQPILEHDSVAFQAARNAENQLWADFNLKPKARWFKLPPDNLRVRVLEFGHGDPVLIIPGNTGDPYPFAPLLPQLAGYHLFVLARPGGGLSDGFDHEQVDVHQFAVDLIGQIMDKLDLKSAPIIAHSMGAHWATWFALAHPERVDQLILLGNPGRMLMTKTPGILKMAMMPGLGQWFMKRQIPKSAKRAWGPLHRMGTDPVAVSKLPQSFAACVYAFDHLPNYTVSTLSLLRSMNSEKKHNGLGEDQLRHLSVPTTLIWGTNDALAKPELGQEIAAVVQRGELVTINGAGHEPWIDEPEKVGTIIRLKLKDSRLRAALGRQ

SEQ ID NO: 7843 - protein, 429 aa, Lactobacillus casei
NADHDEPENDENTBTANLDEHYDRGENASEAVKNFRFKNPTDIRFGTGRLDVELHDAVSQFGSRVLFVYGGHSTKKSGLYDTVKGLLADLQLTELPGIEPNPKIASIREGQQLVKGNDVEVVLAVGGGSVIDAAKVIASAKFYDGDPWDLVKDRGVTRHKLPQLPVVDILTLAATGSEMNSGSVISNPETHEKLGTNGPNTPAVSFLDPTLTYTVPHRQTAAGSMDILSHLLEQYFDRSKNNDASKGMMEGLMRTVIKWAPIAVKEPDNFDARANLMWSATMALNGVMSVANENGWTVHSLEHELSAYYDITHGVGLGILTPRWMEYALTKDSTTAEMFARFGRHVWDLEGDETYAVAQAAIDETFDWIQHLGFPMTLPEVGITDERHFDAMATAAVANARLETRAYVPLSEEDVKAIYQAAMTDGLTA

SEQ ID NO: 7844 - protein, 137 aa, Lactobacillus casei
MQTESNISGLIYQLAKLQKYFLNQHLSDLDLNSDQAKVLTFVAAHPGTNQRQISIDLSRGPASVSNLVKRLIQQGLLEKRMAPHSDRERQLFLTEAGKAAAAEVHELFQVLEKAFATNVKDPEALTQTLKQLLVALQ

SEQ ID NO: 7845 - protein, 254 aa, Lactobacillus casei
MAFCPNCGAQVSADETFCHQCGFNLAQYRSQHQGTDPENGSSNANASSVGPTSQPTGQGAVPPNSRRQRSHGSAPNGPRRPWLMVSLVLAAAVIVVIAVLFFQNQSQQTQEAAASSASASAANASSASFVSASASTSQASASSSLAASQEAASESLANASESAAAESHESTTTTGGSDLSNRQVAKMAADLDDFDLDDYRVEVTSPATNMKEVDVYDKDDGELHNKYRYDEIHDQMSKYDDDSGKWELIQDDDD

SEQ ID NO: 7846 - protein, 362 aa, Lactobacillus casei
LAEKMRYCPNCGFRIPAGVKFCPNCGMDLVQFDARLAAQSATQQTQSHPTMQQTASDTTRAAQRETAGRSRRQQEKTANVKKSLVLTDDSFQHFLDWLATHIVYTLIGALVLFCVFSFSVWIGWLLAVISTVAVYVVANRRVVTPYQSKFSNESPDDDDIWTMPQSAAPGQGANYTAAAGGQSTTSPWPQGMTTNAPQHWWTRLAGKPRRRGGVIWIAYLLAAFVALIAAYVWPFGASGVGTTAVGGSLYDLVRSANTLAETAAAAGTVSSAKANLPYLALVLAGLGPALGLLFGFFRSRGMMRLGGMLGLLGYASLYFAYAPLMSSGSNQTQGLLSPGIGYSIGIGAALVMFVTARLLPRD

SEQ ID NO: 7847 - protein, 249 aa, Lactobacillus casei
MKYCPNCGVRVDSEELFCHNCGFNLAQFRARRTSTSVNQQKQRQSQLKTRTHQQTSEDSASQMLPPQRSNRPNKNRPWVMGAIVIGIFVLLLLGVFYSQKRLDRVSNATDSSKSGEYFDVSSFMKEASKDSAQSRSAEKASTMAENSLNSEVEANESAIDASESGNANLTDHDLDNDQIAQTIAEYGGFDLRDYRVKFSVPASSMTEVDVYDKTNGSLYGKYRYDEIHGQISQYRDETGKWELIKDGDN

SEQ ID NO: 7848 - protein, 194 aa, Lactobacillus casei
MTKTSEALLKAFGSLLQKRAFIGAVTSSLRFGDRQRQPNQLRLLRLLDDKGELTNSDLVEALDIRPSSVSALVQKLEELGLLARHESETDKRVQLIALTDDGRKFIETTGKLKTDLPDQIFAGLSEEEQADLLKLIDKLTADLATRDDLTWPEGKQFDDMRAWAERFHHGHHGPRRGYPGSFGAGGPRGFEPRF

SEQ ID NO: 7849 - protein, 601 aa, Lactobacillus casei
MQRSANETMISQHSAVSKGLNLKGFLNLFSAIHPHYWQLAFGFTLGIVATLGQLLVPTMAKSLINTLGHSLDTKLVIGMLGLFIGSALLSAGSGAVLGFFGEDVVAKLREKLWTKLLVLPVSYFDKTKSGEITSRLVNDSTQVKDLLANSLPQMVTALMQLLGALIFMLMMDWKMTIIMFAAVPLMIVIFLPVATQARKIAFSRQENLAAFSGEAGDVLGAIRLVKSSNAEAAEKQTGHAQIKRLYHLGLKEAVYDAIAQPVMTTVMMALIVGILAYGASRVATGSMNLGTLFAFLMYLTQLIGPFSTLGQFSTEASKASGSTARLEELLQQEEEKRSGRPLADASGKALTMSHVNFSYDDKTPVLKDVSIEAAPNQVIAFAGPSGGGKSTIISLLERFYEPDSGHILIGDQDIAQLDVNDWREQIGLVGQDATVMAGTIRYNLAYGAAKTYTDAELWHVLDMAYAKDFVIAMPQGLDTNVGERGEKLSGGQRQRLAIARAFLRDPKILIMDEATASLDAESEMMVQKALNKLMHGRTTIVIAHRLSTIVNADRIYFIENGSVSGSGTHDELVATHPVYREYVQDQFGQAVPINAQKAVGD

SEQ ID NO: 7850 - protein, 153 aa, Lactobacillus casei
VANYIKEIRSKVGHMPIFLNAVAGAVVNDQGQLLLQQRTDAGNWSVPGGMMEYGESFLETLKREMKEDSGLLVEPIKVLHTFDRGFTTYPNGDQAQIVCRFYLVNPVGGSLEDADPKETLALRYFDFDALPPLFSQQTRDMIDCVRDYLQTQA

SEQ ID NO: 7851 - protein, 457 aa, Lactobacillus casei
MLNAEKAKPKTGWILFLTSLGFFMSMMDSMIVTTASTAIRSDFSISVDQLQWALNAYNIAIAAVLLVGVAIGDRLGHRKVYELGLLIFVIGSILCALSGNIMSLIVARVVEGVGASVITPMSMAILTANVPVESRGKALGIWSGIGGLALIVGPALGGIIVAKIAWQWIFWINVPIGLICILLSQQKLPETKAGSQKINILDSLLVVLTSAGLIWALSASKSVKIPTAAIIVAVLSILFALLLVWRQKREDFPLIPLSFFQRWQFTGANLATALLYAAMYGVVFFLPQFFQVVGHVNAMIAGMEMLPWTGMLVLVAPFAGRAVDRFGEQLIAIFGLFLQGLGYLLIGLIVHDGYTYSLTIVPLGLAGIGLSMAGPALQKAVLGAVSPKNLGKASGLYNMFRLFGGAIGVTISVLIFYAIGSADTSLEFSRGFQAAMVGAGGLSLIGILSALRWRQNA

SEQ ID NO: 7852 - protein, 98 aa, Lactobacillus casei
MIIELSSAQVDEIQVKVFKALADPVRLAIIRYLKKVNKEVTCGEVGEAIKMSKSAGSYHFRLLREAGLTKTRKSSREKYVSLNAENFDLYVTNFYKNL

SEQ ID NO: 7853 - protein, 229 aa, Lactobacillus casei
MAKLVLIRHGQSEWNLSNQFTGWVDVDLSEKGVEEAKHAGQLVKQAGLEFDQAYTSVLTRAIKTLHYVLEESGQLWIPEMKTWRLNERHYGALQGLNKKETADKYGADQVHIWRRSYDVLPPLLKATDEGSAAKDRRYANLDPRIIPGGENLKVTLERVIPFWEDHIAPDLLDGKNVVIAAHGNSLRALTKYIENISDADIMNLEMATGEPVVYDFDEKLNVNSKTKLD

SEQ ID NO: 7854 - protein, 68 aa, Lactobacillus casei
LKKIWLTIGGFWLISVIYFLVYVSTTAFQVAVNENGFLSLVHGVMDLILLGTTFALVAGGLYRLFHRR

SEQ ID NO: 7855 - protein, 341 aa, Lactobacillus casei
MFKICPNCGAHNLVTANFCVKCGTNLADVAVTQEQADTASHTAPAEKPATSSATPISAAKEAVKDETANSASTAAQSATANPSQAPQKPATSTATASTDTNTNSGAENSQPVAQAPAAPKQPNPTVEAGKQYAGSYWRYLVDSIKHPAHIDQSYHPYFGFTSLAITIISLALTIALRVSSTLSSLPGGVASIVLSTFIKLFVMVAILAVAIIAIYYLAIRGILGDRRRNFLEFTTDYAFHANWMVFFSLFTLLMQIVGLINVGSAMLLTLLVALSLGLFLLAGPYMLFTAQPTNQFDKIYAYLIASALLFLVFMVVGMLGLSSIISSLYQGINDIGRSFNY

SEQ ID NO: 7856 - protein, 365 aa, Lactobacillus casei
MAHKKRWLIVIGVLVAVLAAGGLTMAWIQHQRDATKITAHPVPQAQLGKSARKLIRETDFRGSIALIKQGRVVYSGGVGEANHDRKLANTGDTMFPLASVEKYLTALLIGRLVANHQLKLTTKLAKFYPEIAHSKDITVRQLLDHRSGIQMDELMPDNILPSESKALDWNLQQLGSTGQHDFFYTNANYALLVGIIRKVTGKSFATTLRETILTPLNLQHTRNFDELTAKMPVAQGYLTEDDDHYQPDDLSPALLSSLLGSGSEYMSVTDLAKVIIAAETGKIIPPKVYRELISANYADGNRYASGVAWLDDQRLLQGMYNDNPESFSTLAYFRANAASGVVLFGNHTMTTDTVTLAQNLEALVR

SEQ ID NO: 7857 - protein, 358 aa, Lactobacillus casei
MSAYEKFINNVPVRRTVVLFSVFLVLWFARSIMSDILLTFIFAFLVSRLVHAVQRRVHIRPFIIVVPVYILVLLGLVYAAVHYVPAIVRQTITLFNSVQNFYNSDAFANNQVMQWILSSTKSLNLTEQLKTGLSTVLEYAGNIGAMGLTLVLSFILSFFFTIELDSLPEFGKLFLDSPFGWYFKDLRYFAMKFINTFGVVMEAQIFIAVVNTVITTITLLFLKMPNIPSLAIMVFLLSLIPVAGAIISLIPLTIIGYTVGGWQDVITILIMIAVIHVLEAYVLNPKFMSSRTQLPVFFTFVILLVAERLFGTWGLIVGIPIFTFFLDVLGVKKIAGTKSSHSTYASIPQPKEHDGDGA

SEQ ID NO: 7858 - protein, 233 aa, Lactobacillus casei
MTKSSKQQPPRKHRWLWRTIFTLGILLGLALVFNEPIKLFVVDHLSQTTMAHIDRDTVDKNEKKHATFDFKGVKALDINTVGNAAITRNLHPIGKIAISSVNLKLPILKGLSNDNLSAGAGTMKADQKMGEGNYALAGHYMTNQGILFSPLKNVKKGDTVVITNMKHIYTYKVTTKQIVNETQVQWIDDVAGKKLITLVTCASPTEGEVDRIIVQGELQTVKDANSHNLKIFL

SEQ ID NO: 7859 - protein, 136 aa, Lactobacillus casei
LKTLIQLYLRYEMIINYLFIGGLTTLINFVTFFVMRYFGIGLVLTNTTANIVSVIFAFFANKSVVFHSDYSSKKKFWFELTSFLILRGVSLLLDNFIMIVGVDWLHGNEILVKILDQVIIVVANYLFSKLIFVRKR

SEQ ID NO: 7860 - protein, 313 aa, Lactobacillus casei
MFSAEIIMNPSAGNARWKKELPALLALLKSHFAPLRVNRTQQPGDAQIVIEKLLKAYHDHLDELQLIVIGGDGTLHDVVNGLQRRGHPEVAIGYVPTGTGDDFARAQQIPLDPKKAAAALVTAMPRPVRIGVATSAKYGTQYFINNFGIGMDAQIVYQTNHSLHKGTLNALKLGQFAYGASILKALRVQKGFAATWQVAGHSEKHADNAYLNVFTNHPFLGGGIRLFPDAMDQRQRLSLVQVRREKLGTLLQVAVAILSGRSVHNAIHHLEADQFDFVTKATVPIQMDGEEYTTPIAVTLRQTTQMFLLPMTN

SEQ ID NO: 7861 - protein, 586 aa, Lactobacillus casei
MAETIKAGIAALRTLESWGVTHLYGIPGGTFNNMMYALDEEQARIKYIHVRHEEVGALAAVADGKLTGHIGVAFGSAGPGATHLFQGIYDAKMDKVPTLFLVGQVEQRFMNADFFQELDEDPMFQDGAVYARTVTTARSLPHVIDEAIRRAYAGRGAAVVIIPNDLPAESIPADGYYSAAETHATPVLAAGSDEQVDAALRLIGAVSRPVLYVGQGVRGAADTVMTLAKKLQMPVITTALGKPIIPYEFEALLGSAARVASKPANEALRVADLIMFVGSNYPFSEVMFSPKAKFIQIEADPKTLGKRHHTDVAILADAPATLEKMIARSDDAPSSGWYQANVDNVKNWHQYNDDMMQRTTGDMRFEPVFGQINRLATDDAIFAIDVGDVTQNAVRLLKVTGRQAWTTSGLFATMGAGLPAALAGQLSFPKRQVFNLTGDGAAAMVMQDLDTEVRYHLPIINVVFSNNALGYIEDEQEDDGHEWFGIDMPPIDFATVAKGMGMTGITVTQVSELADAFDEAEANRIAGKPTLIDAKITNERPIPVEHLQLDPDRFDAATIAAFKKRYYADKLVPFSEFLQAHHVPVE

SEQ ID NO: 7862 - protein, 301 aa, Lactobacillus casei
LRFYKKIIATLAMMASVLLLAACSSTQPKYDANKPLGPQINYTITGIDAGAGIMTSTDKALKAYGLADKNWQLQPSSTAAMTSTLKKAIADKRPIVVTGWTPHWMFTKFPLKFLKDPKNVYGKTEQIHTIVRKGLKQDDPQAYQVLDQFHWTPKEISSVMLAVNNGQDPADAAKDFVKKHPKQVAEWTKGASHVNGHPKLTLTYIAWDSEIASTNVVATVLRQVGYKVTIRAMEPQPVWASVATKAADAQVSAWLPNTAAKLYADYKNQVVDLGVNMDGARVGLAVPRYMKNINSIEDLKK

SEQ ID NO: 7863 - protein, 283 aa, Lactobacillus casei
MFNLFMNIPTLPLAHWIDSFVAWLTQFSGFFGVLTNFIGSIVNAFQAVFDLIPIWLFIVLIMALTWYLKRDQKYRSLLIFELLGLLLIWNLGFWRDMTQTLTLVLTASLLAIVIGIPLGIWAAESKTVSAIVKPLMDFMQTMPAFVYLIPAVAFFGIGMVPGVVASVIFAMPPTVRMTQLGIDQVPADLNEAAVAFGATSWQQLIKVQLPFARGTIMAGINQSMMLALSMVVIASMIGAMGLGTKVYFAVGRNDAGGGFVAGLAIVILAIILDRITQSLNRTR

SEQ ID NO: 7864 - protein, 407 aa, Lactobacillus casei
MQHKIESDAETKIEVRGLTKIFGKRINRAKEMLKNGKTKPEILKATGATVGVDRADFSIKTGEIFVIMGLSGSGKSTTLRMLNRLIEPTAGQVLIDGDDIAKMDKQGIREIRRKKLSMVFQGFALLPNRTVLQNAAFGLEIQGMDKDERETKANKALDLVGLNGFADQYPDQLSGGMQQRVGLARALASDAEILLMDEAFSALDPLNRRDMQDELLDLQEDMHKTIVFISHDLNEALRIGDHIMIMKDGEIVQIGTPEEILSQPADDYVEKFIEGVDRSQVYTAANVMIRANTVNIDKDGPRLAARRMRDNEISSLCVVNTQRKLVGILDADDVRAAIDAGKKDLKDIVKTDVPTTKMDTPLADLLDAVSTTSVPYAVIDDRDRLRGIIIRGAVLGALAGQEVNVNV

SEQ ID NO: 7865 - protein, 243 aa, Lactobacillus casei
MHYQNVSVGKLIRRVSRFTVEIELEGVTTPVHMNNTGRNKEILIPGSLASVRHVANPNRKTHYDLLAVQRQNRWINIDSLAPNHVAKECLETGTLILPGLTLPYTVHPETTWRDSRLDFAGTAADGQPWFVETKGVTLANGSLAAFPDAPTTRALKHVHTLMMAQAEGYQAFLVFIVQLPDIQEMTIYRDRFPELVTAITNAKQAGVRVLAYDTVTGPDAITLGHKIAFDEQLPFTEIDLASL

SEQ ID NO: 7866 - protein, 153 aa, Lactobacillus casei
LVTENDLTIESVHYNRLLLAVDDDDDDSSRKALNYACTVAKIYDIPLGIVSVLETGDLNIFQSLTPDDVDAAREKMAKNLNTYVEKARDFGVQKAQPIVAEGRPAAAILDEVIPAFKPDLVIMGSHVRRGRLRLGHVASEVARDASVSVIIVR

SEQ ID NO: 7867 - protein, 419 aa, Lactobacillus casei
MKDAPSFTPILLGSDMNVYGMARSFHEMIGGAIDVYAREQLAPTRFSRIVNVHLIKQFDSDPTFIEKMREIAHLHAASAGRLLLIACGDTYAQLVSKHKDELSQWFICPYVDYDLLKRLNSKESFYQVCEEYHLPYPATKIVTKSMYESNATITAPFEFPVALKPTDSVEWLNIHFEGRKKAFTIHSQVELTNTIAKIYDNGYTSDLILQDFVPGDDSNMRTMNCYVDQYHHVKMMCLGHPLLEDPTPASIGNYVAIMPAFDQKLYDQIKDFLEAIKFTGFANFDMKYDHRDNTFKLFEINIRQGRSSFFVTLNGYNLASWPVRDYIVGDLKDAPTVFGNADRSKYKLWLGVPERVFKQYSADNEAKREALQLIKEKRYGTTVFYKPDMTFKRWILLKYMFHNYVGRFKQYFSENKGNV

SEQ ID NO: 7868 - protein, 93 aa, Lactobacillus casei
MKQEPIKSSVLVYPTIFTEFNDEDGHYFTVTSPNIKGMVTEGTTREEAAIEAVDAIATMLDGEPYPPVQDPSNWSLAANQSIVYITVDMAQLK

SEQ ID NO: 7869 - protein, 316 aa, Lactobacillus casei
MERIKSNERVLINIGQHWYYTTASRLSQVIHDTIKAALGPDQHELLFVYSFTTNSRYSLITDGKRLWHLRISDHRQAGYQGFNFDLRNTANFGELREMIRSCLASPNNTLRVGGLAYMLLLVKHAEVMEDVQHNVQIAVGDQVISLSLKRLSMLLDQLKQLKLITAEETGATAVTALGEGVIKRLTTPETLQLWHGDGSLDFSIRTILEVFATGLPKEEKLNMISPYNTAVAVGLKGKPHRFSIPGRLRGELKVGQIIAVRASYRQRALACITELTTVPKEEQLAVHMGWVSKHPPTEEEIAAYLAEKASQAEISD

SEQ ID NO: 7870 - protein, 301 aa, Lactobacillus casei
MIRVSVPATTANLGVGYDVLGMALDLKARFTFEPSTQKLEIIGDEPAFATPENLIYRAFVTFADAIHQPVPNLRITVDSDVPSARGLGSSATCVVGGLAAANAWFHAGWDQAALLKLATQLEGHPDNAAPAIYGQVCATILVGDEPIVRQYPVSQQLHFVVLIPPYAVSTEEARNILPATMSYADATYQMGRCVLMTRVLADGDLSLLRLVAQDRMHEPYRATLIPDYQAARQETAAHDGVLLISGSGSTMLAIVGDAAGAEQLQKAAAQRWPEWQVRIVTPSEQGVQVVKTGELSKKAEH

SEQ ID NO: 7871 - protein, 503 aa, Lactobacillus casei
MRYTSTRDQRVTKTSQQAIKRGISEEGGLFVLPHLTDYRIALQDLLGADYETIAQHVLMTLLPDFNTASLKKAIHLAYRQNFSDKRITPIRKVGDFHVLELFHGPTSAFKDVGLQLLPQLMRLALDPEDRIMILAATSGDTGTAALQGFKNVPQTGITVFYPDHGVSPIQERQMLTTTGANTRVFPIAGNFDQAQSAVKALFTDTGFAARLQAEQVTLSAANSINIGRLIPQVVYYFAAYLQLVNSHAIQLGEPVNFTVPTGNFGDVLAGFYAKALGLPIHKLIAAANANREIADFLDTGIYDRNRPFLKTVAPSMDIQISSNLERLLYYKSGEDSAYVAMLMKDLAKTGRYQVRSDVLATIQADFAGGFATDEQVAGAIAKVWQQDGYLMDPHTAVGYSVMQQYRATGDATPNVLLATASPYKFPRAVAKALDLPVSGDDFSLMAQLQQLSGVAIPANLARLAAMTPQPKHVVAPAAMGAAILDAAKEVFDDDSRVRSGNNR

SEQ ID NO: 7872 - protein, 399 aa, Lactobacillus casei
MNIAILGFGTVGSGVYDIVANGDRRMRVTAIFIRPTHPATMPEMTTDFDAILADPSIDVVVEAIGGLHPAYDYILRALRHGKHVVTANKAVVARYLPEFIATAEQHHVRFYFEATTGGGIPWIRNLERAARIDQVDTIEGIFNGTSNYILDQMQRAHLDFDPVLLAAKDMGYAEADPSADIDGDDIVNKLKISAALAYNMVPPRDVPKFGIRHVSKADIDFFAKHHQVLRLIGKSKRIGDHYSMVVEPRLYPATALAANTFENFNLIRLHGQTIGDLQFYGQGAGKYPTANAIVQDLFDILENVTHLKRDFKQTLQFDPDLSVADYLLRADPLTFAMFNDKQTEVIDHRLLIKQIPVGEMHRLMRGVLAIDAHAFMAAIGDSELVARDVKQQLDQEVIG

SEQ ID NO: 7873 - protein, 448 aa, Lactobacillus casei
MKVAKFGGSSVATADQFQKVKAIIDQDPQRQLVVVSAAGKYGPASQKLTDTLYLIADGMEAGRDVTQMFAQVEARLEAINHALQLHVPLIKLMNTIRHRLATRYSRDYLVSRGEFLTARLMAAYLGYTFVDATDLFFFDQSGAIDEAKTQAAYRQLPKHHGLVIPGFYGQNQAGHVQLMPRGGSDISGAWLARLAQADLYENWTDVSGIKMADPRIIKDADSIDVMSYDELRELTYMGFSVFQEEAVQPVRECKIPTRILNTNAPQDPGTLIIHDDDPSDELRIITGIAGRKHYLVITIRQYQLALHLEVIQRALGVIAAHHLVVDYLPTGIDSFSLLIREPRHQISVRELTAAIKTACQPDKLEVTENVALIAMVSRQLRKRPAIAGKVLAYLDDNLLNVQLVSQTNDDINLLIGVNDKDYDKAVRVIYSSIHQNFHRPAPYIEGIA

SEQ ID NO: 7874 - protein, 523 aa, Lactobacillus casei
MEILADYMPWIIVIVVLLLLFIFLATHRKTALPNEVLIISGALISGKHSFRDINGNRVKLITNGGSFILPILQRWDVLSLNTRTIEVATPEVYTQQGVPIIVNGTVILKIGSSQEEVATAAEQFLGKNDEQINAEATEILEGHLRAILGTLTVEDTYQNRDAFAEKVQDVASSDLAKMGLQIISFTIKDIADKNGYLDSLGKKQIAEVKKNAAVAEAAANRDTRIQQAQADQEAKQQEIERQTQVADAEREQQVKMADFKKQQEIAQAQADQAAIVEQMKAKQVQKEKDIELAQKNAELQEQELNATVRKQADADLYKAQRAAEAQKATQIAAAEASAKQVELAAEANANATKAIGEAEAGKTRAIGLAQAEAIAKQAEAARQLDESGRFKMTIEAMPKIIEAAMSPYANVDSIKLYGDGDLTKQTSGSLVKELDMLQEVAGIDIRGMLNGALMHQAGNQPVVDAIKGRHADTAEKAPQKQSEAPQKQPAAPAAPATSAAKPAATSQSAASAPTKEADKPWKK

SEQ ID NO: 7875 - protein, 129 aa, Lactobacillus casei
MVTWWTQQGLGLQLVVGVVALVIVAGLLWMLLSLVLLPLLAVLQRVLSSVENTTSMSTQDYLLGTLTLAVAPDHTGEVMVTGGGRARQTYPAKLWSGTHRPLEQGTKVVIIELTQGVAYVDAVAAHNQP

SEQ ID NO: 7876 - protein, 347 aa, Lactobacillus casei
MKQDAKTVTMNILNGLSVGIIVALVPGAILNAIVKLLLPSFPQLAVVTYMTTAAMTLLPALSAVCVGMIAKFTPIQTSSLALAAIIGAGNYHLTKTGLTVAGTGDVINLAITLAIGYLVILLLGNALKAYTILLIPSLVLLIAGGAGMLTLGPVSGITKYIGVLVHDITALQPIVMGVLMGIIFAVLIVTPISTVGIATAISLSGIGAGSANLGIVGASFALAVYGWKANPLGTSLAHFLGSPKMQMANILSKPKLFLPMAINAGILGGVGAALNIQGTPASAGFGFSGLVGPLAALDAMKTVTVGNILELTLLFFVLPIGLAYISYLLFTKTLRYQVPEDYALHYD

SEQ ID NO: 7877 - protein, 330 aa, Lactobacillus casei
MTKILMYSVRPDEQAAIDDWVAANHIEVDTNTVELGPKTVDLAKGYDGIVIQQHAAIPDDVVYQKLKAFGLKQLTLRITGFDIVNLEAATANGLAVTNVPAYSPRSVSELVLAQVMRLIRHLGEASAREAKDDYSWGGLEAAEIHNLTVGIIGAGKIGSAVARIFRALGSTVIVSDPVKRPELADTVSYVDLDTLLTTADIVTVHTPLDAITTHLIDADALKKMKPSAYLINAARGPIVDTGDLIQALKDHVIAGAALDTIEGEAGIFGEDRSQTLVDNPELETLKAMPNVEVTPHIGFYTDAAVKNMIDISLDDVKLILEGGHSPHQVN

SEQ ID NO: 7878 - protein, 387 aa, Lactobacillus casei
MALVDRMNQEVLQLQPSDILQFNAEISKIDGIVKLTLGEPDFPTPEHVKAAGIRSIENNESHYTQSKGLPGLRAAASHYLATKYNTKYDPETQILITAGATGGIYSSLTAMLNKGDTVIIPTPIFPLYIPIVMLNGAKPIFIDTSADGFILKPEKLQAAIEANKDTVKAVVLNYPTNPTGVTYSRADLEALAAVIKQYEIFVLSDEIYSELTYTGTHVSLGEVLPDQAIVLNGVSKSHAMTGWRVGITAGPADVIAQVGKVSEFTITSVTTNAQRAAEEALKNGMNDAQPMKEAYMKRRDFLIKALTDAGLTVPHPDGAFYIFAKLPERMHDSWKFVYALAREAKVAVIPGASFGPGGEGYVRISYAASMEDLKLATDRIAKYMASH

SEQ ID NO: 7879 - protein, 234 aa, Lactobacillus casei
MKYTITANNTFPVVDIAMEQDETIQIESGSMIYHNGLVELSGHMNSNGKKGLGGLMSAIGRSVTSGESFFITTATGTAPNAELAIAPGNPGVIKELTLDDGHQYRLNTGAFLAMDSSTSYHMASQKVGGALFGGTGGFFIMETAGTGTMLVSAYGDIIPIQLDGSHEYVVDNSHVVAWDSQLDYNIQPASGVIGFTTGEGLVNRFTGTGTVYIQTRNIQALANLIKPFIPTKSD

SEQ ID NO: 7880 - protein, 271 aa, Lactobacillus casei
MPEKFGLHYQTFGNGQPIVFLHGMGLDGHSMAAFYEPRLTADEKAGYMRIYPDLPGMGSSPAAATLRNADDVLAQLHHFIQAANQGKSYLVGHSYGGYLALGLLARFPTDFLGAFLTAPVVIADKASRHVAKLKHVVKDDVTSEDVDFADYLNMNVVISHATWQQYQQLVRPAVAHFDRPFWDAMKMRHDYRFSFESHLASMLQEPVTMLLGQNDNEVGYQDQLDFAKEHDNIHTTLIQNAGHNLMMDAPDQVMQAYHRFMQESKKDDITE

SEQ ID NO: 7881 - protein, 132 aa, Lactobacillus casei
VAKLNQAMKDMIAGELSYISTVDADGNPDVGPKISMRVLDDEHLIYNEMTGGQTQANINDNGKAIVAVANAKALKGFRFGGTAKLYTDGPYYDQAAKWAEGKFPVPKGAGVITIDKIWTLDPGPKAGKLFEA

SEQ ID NO: 7882 - protein, 197 aa, Lactobacillus casei
VATNTKMLETEVKIQKAFIQLLQQEGFGKISVQQLVKLAGISRGTFYLHYFDKYDLLNHYEDEIVSHVNSIFERFPKPFTQNDRSKTTHENDAFFQLFKYLYHQRELAALLLNEGGTQLVTKVKQLIVAVLRQGAGDSVEQSKQVPSDYAQEIVSQGVLDIIVYWLNQLPVLPPEDAYRIFRQTRMLTPEELTRQIK

SEQ ID NO: 7883 - protein, 376 aa, Lactobacillus casei
MLKSEWRYLFQHKMMLVVLIAIALIPAIYCFIYLSSMWDTYGKMDDIPVAIVNHDQSVTYHGNHITIGKTLTQNLDKSNSLDFHHVSAKTADRRLRQGKYYMVLTIPKNFSKMATTILTAKPQKMNLYFCFNSGQNFIVSKMTTGAATAIKAKVSAQVTKLDATVVLNALHQAAKGMTKAANGSQALASGAQKLTTGESQLLTGTTALSAGVDNLAAGNTKLIAGNTTMTNGFNQLEDHAATLTTGLDQIQNGLNQLAQKSPALAQGTIKLKQLAQNMQKQLASGNTDQKQLAAESSALTSGLQSMTSGSQAIDSGSSKLATGAATLNNGLTVYTNGVSALATGNQAIAQGLATVQTNLPALQSGTEKLNTACRPC

SEQ ID NO: 7884 - protein, 251 aa, Lactobacillus casei
LSGSQQLGQGSQTLAESLTAAVQKLSVIHTKAGNASALATPVHEVTSDIAKIPNNGTGMAPFAIAIGLYVGGIALGTMYEGFLPHKKPRHALTWWASKASVVGSVGLLQAILLYWTLTSGNHLHVTSQGAFFGTILLGSVLFLSLIFCLRLLLGGFGTWLVSIVLVLQLAGSGGLYPTYLVNSFAKAINAWLPMTYLIDALRSLISTHQAITTNIWVMIALIVGFNLAMILRFQIGLHQSFIEIETAAEDN

SEQ ID NO: 7885 - protein, 323 aa, Lactobacillus casei
MLKNIKPISISNLITKASHQRIETSRRVLFLNLIVYILIAGAELAIGTADHSTALIADGQNNLTGIVSVTALIVGLTFSKRPSDGFHLEGHWQFESLAVFLAGLGMFLVGLVCVWKGITQTFGFLAGHYTAPLKGQAAYMAAISGVTMLSLCAFNHFIARKTQSSSLAASARDFLSDALTSTGTMLAIIGASLFRIHWIDPVAALFLGFFIIWNGCQILSTSAEKLSNGFSPKLRTDIIDKILTVSGVMDVTFVDGRYSGNNIIIEAEITLANDDSLTKSYRVCKSIEQILQASFPVLYCCIQVKPAPKSASAQPQAIIWKPF

SEQ ID NO: 7886 - protein, 122 aa, Lactobacillus casei
MQHTDCIFCQLPKSKVVLKNNLAIAFWDIHPVSRGHLLIIPRAHRQDYFELSQEELLAVNDLIHAGKKLIDRQFHPDGYNIGTNVGQYAGQTVMHCHIHLIPRYQGDDPNPAGGVRKLLRRR

SEQ ID NO: 7887 - protein, 634 aa, Lactobacillus casei
MCGIIAFADKTILNKKPVINGMMDMIKHRGPNSSGEYINDDVALGFRRLSIIDLKGGSQPILNEDGTVAIIFNGEIYNFQSIRKDLIAAGHVFKTHSDTEVLLHGYEEYGMEELLKKIRGMFAFLIWDDNKKEMFGARDFFGIKPMYYYHDGDTFIVGSEIKAFLKHPKFKKQLNKEALKPYLTFQYSALDETFFKGVYRIPEGHYFTLKDNKLTIKKYWDMDFKANHLSFDETVAAIDKSVSESVEAHRISDVEVGSLLSSGVDSSYITALLRPEHTFSIGFDNKKYHEGTAAKELSDKLGLDNTSDIVTEKEALDNFPLIQYHLDEPDSNPSCVPLYFLTRMAHKDVTVILSGEGADELFAGYANYGFHTRSHAIRVFADGLRKLPRGVKYRIAHGLKKMPNFHGRLHLYESTAPAEEFFIGEALVFHEGQADEILQPEFRQSKSVRDIVTESYKKVRHYDDEVKKMQYLDIHQFMPKDILLKADKLSMANSMELRVPFLDKEVAKVAAGIPTKYLINSHNSKYALREAANRHLPEEWASREKLGFPVPVKQWLEDEPFYKEVRKTFEQDWVKEFFDQDAILDILDKTYRKERDDRRKVWTIYTFLVWYKVYFIDTEIPHYIADSNKDKIEA

SEQ ID NO: 7888 - protein, 356 aa, Lactobacillus casei
MSITIRPFVKKDLGRFINAVAPLLPASAVNFALITDTHDKAKFATTYYGPTGYWHVREQGWLSTQLPLALRVHLGDLVDGSESPWLTKLRLRNIMADYRRGQVPFLVTKGNHDDNDKFAEKQPGHRGSFLPDVAQQLIFAADATQRHVAVSREGLLVQDFPGLRIIVLNTADVPLHDGRKIYDVKKTLAVSFAQLRDFVLALKGAQNRDVLVMSHAPAMKQNGQPALKFNGRAVHELLRAFNLHASGLLNTGKTPEFGGQLCFDFTQTTGKIIAYLAGHYHLEADYQVNGIHYSLQNTSALMGRHHGLTTKFNRRYDRRFGTPSEYAGYVVSVDVQRRLLSLYGYGAASRVRRFVY

SEQ ID NO: 7889 - protein, 304 aa, Lactobacillus casei
MSLSVFLELVEIKAKTASVFPFLLGTLYAWYHYHTLHIPELLVFFVAMLLFNMSVDANDNYQDYRRSERTEALHFREKTNIIGVHHLNPSMIGWMVVAMMATSAVLGLWMVSRTGWPLLVMGLFSFAVGYGYAGGPRPISATPYGEFFSGFTMGFVIFLIAVYVNVFNVADFSWPLILSVYLASGLAQCAISALLLANNIADREEDETLKRRTIVHYLGLDRSIIFFYGLYTVGFLMLIASVLLGLLPKLTLLTLITIPFVIKNARGFAANPVKKLTFPNAIKNLFVTTLAQVIFLALGVFLNI

SEQ ID NO: 7890 - protein, 322 aa, Lactobacillus casei
MIHPLWHRFPTVYHQLEQIQQRLEQVAVLREPQVHTLIQQQINAGGKMLRSGLMLMLARFGQPDNGDLVTAGAAIEALHLATLVHDDVLDHADIRRGMATVSAESGNREAIYAGDFLFAIYFQLLSEQNPEVVDLGANARIMKRIFMGEVDQNGPSAPLIPTIDAYLSAIAGKTAALFALATYTGAVIGHLSLEQKKAAYRFGRQLGMAFQMIDDLLDYTQTSSTLNKPALEDLHNGIVTLPLIYAYQIVPDQLAPLTQDATHIAANAEKIAAIVRIHGLPQAQQMAATYTNRAVAALAPFPTSATKSALVKLTQQMLKRSH

SEQ ID NO: 7891 - protein, 401 aa, Lactobacillus casei
MVKILSINAGSSSLKWKLFDMPSERQLAEGATDILRNSTVKIKYGTDQVYESTTPIHNYREAVANTLSDLQSLGLVHHLNEITGIGHRVVAGGELFSAPIVIDNRVLAQIRALRDYAPLHNPVEADCIEIFRTMMPWALEVAVFDTAFHQTMKPVNYLYSIPYEYYQKFGVRKYGAHGTSVRYVSAHAAKMLGKPLESMRMIVMHLGAGSSITAIQNGKSIDTSMGFTPVSGVTMGTRSGDVDVSLIAYLMKKLAIPDVDQMIDILNTQSGLRGISGISHDVRDLEEAAPQHPRAKLALDIFVNRIVKYVGAYAALMDGVDTLVFTAGIGEHSSAVRARVMQSLDYLGARIDLQRNEQTCHQAGDITAPGARVKTLVIPTNEELMIVRDVMSLSHAAQQAE

SEQ ID NO: 7892 - protein, 295 aa, Lactobacillus casei
MLNVTNLTKHFGKTTAVRNVSLSVRPGEILGLIGQNGAGKTTTFRMLLNLLQPDSGTVTWQDRPLTQLSREMIGYLPEERGLYPKMTVADQISFFAELHGMKRTEAMASLDQWLEQFQVKGKPTDLIKDLSKGNQQKVQLIAAMIHMPKFIILDEPFSGLDPVNASLLEAGIRRLRDAGSAIIYSSHDMGNVEAISDQLVMLKNGEVVLSGKLDAIREQFGQTRLHIQSPLTQQELQAFPGVVSVTPQSRGFLVKLNDPQVGRDIFAAATHQGYIPEFSQQAPSLDEIFRMKVEA

SEQ ID NO: 7893 - protein, 423 aa, Lactobacillus casei
MKKMDVIFRQVFFKNLKSKTWLWIVLGPLVLAAVFGGVFWLMNQTNQTTRIGVVTSSPALTQTFKANSNDDQKYISYKTPSAAKSALAAEKLDGVLTITSHPALEASLMKRTDGESIDRTQLQSILAQAHTKEVATQLNLTPSQLQQLFATPKFTTNNVTIDNGKLVTRSAKSQASGSAAGFIVGLLIYTFVISYASMMAQEIGTEKGSRIEESILTAITPQAQFFGKLLGILTLMATQIAIYAVVGLAGMVVLRQLPSNPLSSLIGQMNLSSITPNMLIFSLAFFFVGTLTYTVLAALTGSLVANQEQIGQATTPIVMLGMVGYFGALIVSSGTSPILNIASYVPFLSTMMMPVRLGAGQVSALAAWSAFGINLIFLIIFTWLTVKLYQTNVLSYSDGGILKAFKRSLQLQRTARKNNPIKS

SEQ ID NO: 7894 - protein, 130 aa, Lactobacillus casei
MRIVISNQSGKPIYEQIEDQVKAAILSGQLKVNEQLPSIRSLARDLRISVITTTRAYHELEAAGFITNVQGKGAYVLGQDSALVRENALRDIEASLNQAIDTANMAHIAPSELHTMLDTLLQAEETDHGR

SEQ ID NO: 7895 - protein, 288 aa, Lactobacillus casei
MGADLLTVTNLNKQYAEFQLADVSFQLPAGYIMGFIGPNGAGKTTTIKAILDMVRPDTGQIDLLGQTTPQGRESVRDQIGIVLDGPVYPDSWRAETVSRYVGPFFPSWDPDKFKELLQDFAIPTKPKYHDLSTGAKIKLQLAAAFAHHPRLLILDEPTSGLDPIARDELIGILQDFISDGQRSVLISTHDVLELAKVADYVTYLLAGKVTFTGSLDELLDRYVMIKGGPNDLTPAIQANIIGFQRSVVGFAGIWPTDQTAVLPASIIQEPVDLESLMIAFGKGGRPHA

SEQ ID NO: 7896 - protein, 214 aa, Lactobacillus casei
MHDLVKLVCLDLSSLYGSKRLYFWATLNSIVIYFIIFLNGNLAMPFAGGTIGASIGILMMPFVVADRHGLEKVYTMLPVRRQTIVASHYLFGLIMMVLIDLSNILTIGIGLFARSNPVRDFQDVGWLMLIGTAFIILQITLSFPMMIGMGFQRAPLAAYLPMVFVLVVAVFLDKSLNFTLDSLRPWLGLIALALILLFALSWWLSIQLYQKREF

SEQ ID NO: 7897 - protein, 63 aa, Lactobacillus casei
MNHLIGMLEGANKKTASGKQIGRINGGYSTEKPRMMIAERTNLTQGDGTANQRSKMRRQYNGI

SEQ ID NO: 7898 - protein, 372 aa, Lactobacillus casei
MRVGVVKEQKAGEGRVAVTPANVKKLTAAGAEVWVEHAAGIGAGFSDADYEAAGGKLVSHAASWDADLVVKVKEPDAEEYQYFKSGQVIWGFQHLASAPETVHAMQAAGVTAIGGETIVKDGELALLKPMSAIAGRRSVIMGAYYLEAQHGGEGILLPGTPEVAPGNVVIFGGGTAAFNAATLALAMGCHVTIIELNPERRTWLEQKFAGQDLTVLASTPENLAAAIKTADVFISTILIPGAKPPKLVTTAMVQSMKPGSVLVDVAIDQGGTVETIDAPTTIESPVFTKYGVIHYAVPNQPGAVPRTATLALASGNIPYLLAIATQGIDQAIAADPALASGVNLYHGKITNQSLANSLSLPFTPLTEVLVRN

SEQ ID NO: 7899 - protein, 339 aa, Lactobacillus casei
MLTMTPPVTIKDIREASQLIHKVGRVTPLIQSMFLSRTVTHGDVYLKLENMQLTGSFKFRGAYNKIHHLTDSEKQRGVITASAGNHAQGVALTAHLLGINATVVMPETAPLAKQQATSGYGARVILAGQTFDEARAFMEKKAAADGLTIVDPYNDPLVIAGQGSIGLELLEQLPTIDTVIVPVGGGGLISGIAVALKHVNPQIHIIGVQSENVHGMTASLQAGHLTRQCAGSTLADGTAVAMPGDITFGLASDLVDEMVLVSEEEIAEAMKDLLQRAKTVAEGAGALPTAALEAHKIAAKWLTDKQVVALVSGGNVDLERVAQNIEHFFDHDPTGHFVG

SEQ ID NO: 7900 - protein, 641 aa, Lactobacillus casei
MEKTISKRTAAKTKYVPYATERTQENSGGSTAIFIIGAVLATIFAASTAYSGMKAGLTVAAGIPGSIIGSGLVGVFAKKKGLFGKNLLQGMSSGGESIASGMIYVLPAIIIIGGRVNFFAGIVVGALAVLFAVGMASLVENYLLVEEDGKLMYPESTAISEALDASEAGGDALKHMGIGFGIGGVITLLTTQVFGWVNSVMTFVGSASYRWKISTEVNPMLAGIGFVVGLDVSLTMFAGSILANFGITPLIAYFTQMAGGHAHVWNDAHMLMSQMNIDTVAGSYTKYIGAGMMLCGGIIGAIKLIPVIVTSIKKTLNARNNSGEEKNSLGIMALLVATIAIFIVGAFLTGNMVITILAGIMSLVLALLFVIVSARLAGTIGCSNAPVSGMTIASLVVMTLVFALMGWTSNTHNEILLLFGVFIVTAISVGGAYMQTQKVNYLVGGRRSEMMKYFLLAALIGVVVVVGTTVILSPQLAVKSADPPFGLPQANLIATLTTGILSSNLPWIMIIVGIIMALVCWMLNLPIMTVALGFYLPISTTSIILVGALLKLFIQKTTQNKKLRETRLSAGVSLSSGLIAGGSIIGLIGIILHVTGVLQNRVPAGFAGSNAMAVVLLIIMAAAIIVPLMAIKHPAAKKQAE

SEQ ID NO: 7901 - protein, 120 aa, Lactobacillus casei
MTQTDMLTTVIYRKNSQVQYTKKNGKVTIIRPQNHAIQRFCRKVLHMKIPEVSYLHLDAYGSFVFSKINGRRTAAMIGKELAQKFPEADDQRDARLALYLNQIAEKDHLIQRLDHHPNFL

SEQ ID NO: 7902 - protein, 475 aa, Lactobacillus casei
MIDRIEMSACTSMMVGKKASLDGATYISRNEDRLVAIYPKRFIVQPAVTGRKETYVSPYNQLTVPLPETGYRYTATPDADQSAGPNEEDGFNEKNVGESATESVYANERVLAYDPFVKNGLAEDSMTTLVLPFINSAREGVRYLGELVKQYGSAEGNGVQFNDQNEVWYMEIVTGHQWVAVHIPDDCYAVAANQVAIQTIDFNDPDNYMWADGIQDFVDRHNLNPDDDQWNFRHIFGTDTEKDHHYNTPRVWFAQRYLNPETIQDPESPELPFIRKANRKISIEDIQYVLKSHFNETQFDPLGSDSEHDRKTYRAISLSRTANSHILQMRPADQHPAAGVQWVGFGIPAFCPHVPFFTDANDTDESYRELPAKMDLNAAYWLYEALAMVVESHYADFIEDDLAYQKELNEWARRKIAEVDDATAKMSGSDLTQYLTEQNHLIAQHYNDATRELLFKLITMGTGLSKLTFKMDPNL

SEQ ID NO: 7903 - protein, 444 aa, Lactobacillus casei
LKNPYDFDVLYLGSGHGAFDGAGPLAASGKRVAVVEGDMIGGTCPNYGCNAKITLDTPVVLQRLAERMQGVVSGNIKINWSALVAHKQAVIKPLPDAIGTGLTQNGVTIIHGYGKFQDAHTIVVGEKTYTADKIVIATGQRPHRLDVPGTELAHDSRAFMDLDVLPKRIGILGSGYISMEFATIANAAGADVHVLMHHDRALREFHQPFVEDVMADMTKRGIQFTPNAVVTSLEKTDDGIVIHYGDKEQLVVDWVLDATGRIPNVEQLGLENVGVEFNQHGIPVDDYLRTNVTNIYASGDVLDKPQPKLTPTATFESYYLYKLLSGQTTAPIDYPAIPSTVYTSPRIAKVGVAPEAVKDDTYKVVHNHIPDDWYHQTDQETVGDSLLVFDQEHHLVGATEYSAQAEDAINTLLPAIVYHLSRDQMWQMAHIFPAEGAAAWHKIR

SEQ ID NO: 7904 - protein, 472 aa, Lactobacillus casei
MQLSQTKAMPQARVHIAHPALAMIGLMIGAFVGMFSETSLNIALPSLMTALNVSQGTIQWLVTGYMLVIGICMPISSLLSKWFNTKRIILFALGAFILGSVVSAMGASFAVVLIGRLIQGIGTGLILPLMFSVAMQIFPPYKLGTVMGLAALVIMFAPAIGPTITGLILAKFTWHDIFWLFVPFLVLAFIFTLTSMENVYHQTKTPVDWISIVASSIGFAGIVVGTTMASDSGWLSLTVAVSLLIGIAGLAFYTRRQLTLEKPMLNLRVFANKQFTVGTLLVMLDFGVILASMYLLPMYLQRVIGLPVAMTGLVMLPGGIVNAAVSAIAGRMYDSHGAKWLARGGFVIAILGILILLNSGAQSPLWWIILGHVTLMIGAPLAMSPAQTYGLNSLSGAESADGSALLNTLQQIVGAVSTAVATSMLALGSAQAAGQSGLTVGSHYGFAFVLILAVVGLIVAFQVKKPQVSRDL

SEQ ID NO: 7905 - protein, 188 aa, Lactobacillus casei
MNTREKLVATAADLFQEEGVRATGLSKILAVSGTPKGSLYYYFPEGKVQLIEAAIEYAGAQILVRVKQALERDAAPEIALTGQLAEMAEEMQQHGRLSSHSISLIALETRDDPKLQAACSAVYTQLEDLYTDKLVSAGMSVVPARQLGQFVQATIEGTIMIATTKANPDLLRQTAAHLSYLIKQALTS

SEQ ID NO: 7906 - protein, 950 aa, Lactobacillus casei
MACSKKRRQPNSRTYIKKGMTMNKVYLKHKEEVLTALTTNRTHGLTSAEAEARLAKFGPNALKAAPTIPAWRQFLLTLKEPLVIILFVAVGLALLSAAYDFFVTGNRSHGMAAIYESIAILILIGVNSGLGYWQAQSAKKSMDALRNMADHQARVLRDEVWEDVPVAELVPGDIVRVQTGDFLEADVRWLRVANLQTSEAHLTGEAEPVSKQSHALTEKVELGDQTNMGFSGSMITAGNGYGVVVATGMETELGKIAKLMNDVQTQKTPIERVVHSLSKKLMIVAIGIVFLTLGLALFKAYQQTGNLSFEILAASLSTAIALAVAAIPDALPAVLSIVLTIGATKLAKNQGLIKSLNSVETLGATNYIASDKTGTLTKNEMTVTRFFANGAHYEVEGNGYDTTGDFLPVNEQDTPAVERFLQAAVLNNEANVTQDEDGRFQPFGNPTDVALVVAGAKGGIDRATILEKTDQRDIDILRVLPFDSTRKMMSVVIKENGQFKVLTKGAPDVILRKTDQVVDHDQLVPIADARATMEKVILDFANDALRTIAITERAIDESLALHGETAELEQHLTLLGIAGIIDPPRPEVKRSIQTLHAAGVNVVMITGDHAATARAIAYKLGIVQKKDAQVIEGAMLDKLPDAELDDVVLEARVYARVSPEHKLRIVKALQRRGQVVAMTGDGINDAPALRAADIGIAMGINGTEVTKDAADLILLDDKFTTIEKSVAAGRTIFGNIKNFMRHELTTNVAEVLALLLGVILMTGPIGHVSVTTPTLTALMVLWVNMISDALPSFALAYDKPQADQMKQKPRDTSASILKGMVGRIFVRGTVMGGTVYVAFIWAASAGLPAAAAQTIAFLTLVFGQLWHVFDARSTTTLYRRNPFSNIKLLAAVSFAAVSSLLVTTLPFFNVVMGTQMLTWQQYLLVTVLPAIPTLVLSGIKEAWLAVAGKK

SEQ ID NO: 7907 - protein, 483 aa, Lactobacillus casei
MTYLNFPKQFMWGGATAANQLEGAYLEDGKGLSIADVLPQGKARFDLVNEPDFDWTIDESNYRYPNHRGIDHYHHFKEDIKLFSEMGFKCYRFSIAWSRIFPEGDEKTPNMAGLAFYDAVIAECLKYGIEPIITISHYEMPLHLVTKYGGWKNKQLIGFYKRFAETVLTRYFKQVKYWMTFNEINSALAFPVMSQGLVTSNGAADKRNIFQAWHNQFVAGAEAVRIGHQLNQDLQIGCMLLYATTYSYDANPVNQLATLQQNQAFNFFCGDVQVRGEYPAYTDALLDQYGIKLTDLDFSAAELAMLKQHPVDYIGFSYYMSAVVETVQKDHAEVGGNLLSGIKNPFLDASEWGWQIDPTGLRIALNQLYDRYRKPLFIVENGLGAVDQPDANGEINDDYRIDYLKQHIEQIGAAIHDGVDVMGYTPWGCIDLVSASTGQMSKRYGFIYVDLDDAGQGTLKRSKKKSFDWYRQVIVSNGADLDS

SEQ ID NO: 7908 - protein, 628 aa, Lactobacillus casei
EIIBCACMPNENTMGESTLAKQLLQLVGGKQNIEQVWHCATRLRFTLKDPQKATAAKQKVEALDGVITVVEASGQYQVVIGNNVSDVYQAIIKLEPSLGDSAQAANDQPKEKMTFKRAFNGLLTFISGVFTPFLGAMAGAGILKGLLSLAVAVGWLTTKSGAYQIWWAAADGIFYFLPIALAFTAAKHLKVNPFVAMAIAAAMVYPNIVGLVGKPSIDFFGIPVVAANYTATVLPILLVVVVQKFLEPFFNKIWHQSVRNILAPLCLLVIIVPLTMLVVGPVSSILSNGLATAIVSLNKSVPALAGMVLGGFWQVFVIFGVHWALVPVMMNNIAQYGTDPMMPILLPAVLAQAGAAFAVFLKTRDAKMKSLAGSSTITALFGVTEPTIYGITLKLKKPFYCACVAGAVGGIIVAMSGAGSNVASLASILSLPTYIGKGFGISVIGDIVAFVLGVALTLVFGGINAGVKEDKPQATQIAADHAETLTAPVKGTLVPLSEVPDEVFSSGTMGQGIAIEPEDNLVKAPIAGTISLVYPTAHAIGITSEKGAEILIHIGIDTVNLKGKYFKPLIKQGQKVDVGTPLVEFDYQAIKAAGYAPTVMMIVTNSDRYQVETRADGATADDALMTLA

SEQ ID NO: 7909 - protein, 286 aa, Lactobacillus casei
MIIETILNNNAVVVRHEQRETIIVERGIGFHAKKGETLTLRDSMKVYVPEDQTKLKIAAETIASLPSEYLTLAARIVQEAEVQLQTTFNSYLLIELADHLHFAVMRLHDNLLLHNRLLWEIQMAYEQEYRMGKWALEAVAEQLGEALPEDEAGFIALKFVSNDLNHQQPVDSLAFTQMLANVTKIIFYRLGLDMNTKTPEYQRLAIHLKFFLQRVYAHTDKQEATYDHALFAHLQEDYVQAYQCMEDVVQFIEQKVNVPVSKNEQIYLTLHISRLAASHGQNLKSS

SEQ ID NO: 7910 - protein, 539 aa, Lactobacillus casei
MIRGLLKYTHHLTGAIVISFLIGMVAELAKAVVLILAAMMLFDPQHATELLLPGVIAVILLGLGSFGEQYAGHFVAFHVLADLRGAVYQQLVRLAPAKLDTQSSGKLLKLIGSDIEAMEIFYAHTIVPVAIGLTYGLLMTAVYSRVSILAAVVALVGYVAVGGLIPYARHQQLTAKTQAADQLKAANQQYLLESVRGMGAVRQLGIAKERMDQGNVGFDREAAAFQQAQFSQLLKNVAATFVMVATWLVMVWISGWQQATALQQAVLAVFPLTFGPLLALNNLPGSLLNGFAAAKNLFNLLQEQPLMAAPATASQTVDAIKQIQVKQVSFSYPARPEEVLNDVTLTLKAGEITGFVGASGSGKSTLAKLIMGWYPVTSGQILVNGTDLATINPQSLRAQINYLPQTAIFFSETVRDNLTLHDPTITDDQIWTVLAQVKLSDRLKQLANGLDTQIAAGHVPFSSGEQQRLELARALLHSSSVLVLDEPTSNLDTENERLILDTIKAYYHGIVILISHRAESAAYADRIYRFSNRQVVEEE

SEQ ID NO: 7911 - protein, 562 aa, Lactobacillus casei
MLGLLKYGRDKLGAGVIEAIFDWLPTVLPVIIALELAANRAMEAIVVAGVVGIFWLLYITIYERHHRHDWAMSAKRELRDRYFEALYQRNDASAATGADNAVIQRDLGGLNNLDMFYSTLFPTSLQAMMTYLLLIALSIWYRSWLALLPLACVLLIGFAMMFLGKQMSAQNKTHLAGFLKMGGRFINDLRGMNTLVMYNAADHYGQKFADDSEYFRQATMNLLKTQLQVLFVINGFVYLTVFVGGFVTALQLIGGQLPAAGAFATWFTLAMMMVNARQLGYFVHVVKSNGPSLAAILGTIAKAKATPATVRITDNRPLKQIALDQVTIGYAPDKPLVTAIDATLEPGKLYGLAGENGTGKSTLIQAILGRLEPLSGTIMADNTAVTALSNAQKAAVFGYVTADEYLFSGTVQENLLLGNRVGDTWQQKLDDLGLMQFVPKLEKGYDTQVGEGGRLLSPGQRQQLAFARMLLADKTVYLLDEITSSIDKVNAAAILAAVKKLSQEKIVLFISHDLAAMAQADVVWFIHDHHLIVANHAQLYQDQPAYRRLVDNPETMQKEGAR

SEQ ID NO: 7912 - protein, 141 aa, Lactobacillus casei
MRWLKKYVRPLDYVIVVLLFIACFIPLGIFSMTEAHVNTDQKVAVISINGHVKRRIKLDAHAGHQQFTLYPAKGQYNVIEVDGTRIRDKEDNSPDQIAVHTGWISQIGQQSICLPHKLLIEIKPAQGNKGTSGDDGGLVHP

SEQ ID NO: 7913 - protein, 575 aa, Lactobacillus casei
MHWWKNEHWVRPDLKRYRWLLFWSLVLGVMTFVFAGALMFTSGFLIDKSATKPLFAAIYVTVVLTRAFGVGRPVFQYVERLTSHNWVLRITSHMRRKLYKVLETDAAFVSEHHQTGDILGLLADDIGHIQNLYLRMIFPTVVGAGLTVIATLLLGWFNWGFALWICLLLLFQILILPWWGLVVERFRKAEQKQLNHDAYVSLTDSVLGLSDWVITHRGQEFLDQSLAAPKKLAASTAKSKRFQWGRDFVGQLLFVLITISMLIWTNLEWTGSQSSANWVGAFVLVVFPLDQAFSGIAQGVGEWPTYRDAIRHLNDLHPVTRALPKQQPVPTSFKTIQLKQVSFRYTPTDPELITDIDLTVHAGEKMAILGPSGMGKTTLLQLVLGDLTPTTGQVLIDGQDVLTYQQNRTNLFAVLDQSPFLFSTSIINNVRLGNENASDEEVAAALKAVKLDKLIAQLPNGMDSSVEEAGFAFSGGERQRLSLARILLQDAPIVLLDEPTVGLDPITEQALLDTMFSVLKGKTILWVTHHLQGVSQTDRVVFLEDGRLTMNDTPQHLAEQNQRYQNLYALDAGLR

SEQ ID NO: 7914 - protein, 565 aa, Lactobacillus casei
MTMLAGFALVQAFVILLQGKFLAEGIVHSWNRQSLAGLWMPLGLFALAFTVRQLIVWVRNRIGARFAMNGSAWLQEQLLKHLYALGPAAVAKEGTGNLVTMALDGIPEAENYIELILNKILNMSIIPWVLVAYIWYENWLTGFTLLIMFPIIILFMVILGLAARDKSESQYAGFQKMSNHFIDSLRGLKTLQLMGISRQYANNVYEVSEDYRKQTMGVLRIAMLSTFALDFFTTLSIAVVAVFLGIKLMDGGIPLYPAMVALILAPEYFMPIRDFGTDYHATLNGKNAMAAIWKVIDQPLPTDTKVLPEFDGWQDQDTLSMQHLDFTYNDKRAGIQDANLQFTGPEKVAIIGASGSGKSTLLNLIGGFLQPQSATITVRGTKVPHLTQAAWQDHLSYIPQDPYLFADTIAANIRFYRPSASDDEVRQAAAAAGLSHWIETLPDGYATRIGEGGRGISGGQAQRIALARTLVDTNRSIWLFDEPTAHLDIETEAELKETLVPLFKNRLVIFATHRLHWLNQMDRVIVVDGGRIVAEGTPSELAAHSKPYQALVHEMRGEFNALVEK

SEQ ID NO: 7915 - protein, 337 aa, Lactobacillus casei
MSWLQILWFFLLFVLFSGFFVLEGFDFGVGMSTKLLARNTSEEDQLVATIGPHWDGNEVWLITAGGAMFASYPMWYASLFSGFYIMFFIVLFGLIVRGVSFEFAAHAETKTGRNIWRWALACGSLIPPFVLGMIFTAIIQPLPITKAGDVYPTLGNQINLLTIVGGVAVTLMMLMHGLNFIRLKTTGDLRKRARDWNSKLYYLLYAGEVVFAVLLFFMTDFFKERPISTLLILVVIVGSTVAAHIGVLKDNEVLSFVGSAIGLVGVVGVIFNGLFPRVMIGQDAAMSILAKDASASSLTLTIMTIVAVILLPIALIYFIWSYVVFHKRIQAKGAVSE

SEQ ID NO: 7916 - protein, 474 aa, Lactobacillus casei
MLMAMDVLSLARFQFAMTTVFHFFFVPFSIGMGLVTAIMETLYVRKKNETYKKMAKFWGKIFLLSFAVGVVTGIIQEFQFGMNWSNYSRFMGDIFGVPLAIEALLAFFMESTFIGLWMFTWDRFKPAVHAIFIWMTWLGTTLSAIWILSANAFMQHPTGFAISQTTGRVKLVDFGAVITNPQLWVEFPHVIFGAFTTAGFAVAGMAAWRLLKKDQVDFYKKSLKVGLVVGTIASACAIGFGDLQTQFIIKDQPMKFAATEGIYKDTSDPAPWTLVELINTKDHTTSGNIEVPYLLSLLSYHKMNGSVKGMETANKELQAKYGKDKDYYVPVKTLFWSFRVMAGGGVLLFLLGVLGLWFGRKKKDTLLNQRWLLYILGFALWLPFIINTAGWFITELGRYPWVVYGLYTIADAVSPTTTAGQLLFTNICYFLIFTLLGGVMIYYSHRVLKKGPEGDLNTDYGVNSDPLAKEAFAK

SEQ ID NO: 7917 - protein, 434 aa, Lactobacillus casei
MRMVDLITKKRDRGELTNEELTWMIEQYTADNIPDYQMSAFLMAVYFNGMTDAERNHFAFAMLHSGDVLDLSDIPGIKVDKHSTGGVGDKISIPLAPLVACLGVPVPMISGRGLGHTGGTLDKLESIPGFNVNESEAQFKKQVRTIHEAIVSASREVAPADRRIYALRDVTGTVESIPLIAGSIMSKKLASGTNALVFDVKVGNGAFMKTIKDAHALAKALVSISKTAGVKSVALLTDMNQPLGITIGNSLEIAESIAVLKNRGPRDVHDLTVALAAQMLVLGGKAPSLEIASGLAEDALRDGRALNAFKQLIQAQGGDPTVVDDPRKLPQAKYRIPVTADQSGVVDQIDTNALGLAAMQLGGGRAKKDDVLNLAVGLVLHKKLGTPVSKGDTLVMLHADTKDVVDIVGLVQKAYHIGPSAPKKSPLIHEIIRP

SEQ ID NO: 7918 - protein, 339 aa, Lactobacillus casei
MDFDTLHALGKTELHCHLDGSLSLSCIRQLAKMINRPLPASDDALRQLVQAPADSENLADYLKTFDFVAPLLQTKKALQLAAFDVVAQAAEENVRYIEIRFAPAFSISGGLSLSDATEAVIEGLHQAMTKFDIVAKALVCGMRQLPNADNQAMFRANAALLGNGLVGGDFAGNEADFPTSVCAPAIKTAQRLGVPLTFHAGECHCPQNIAEAIFLGIPRIGHATACFDQPDLIQKIVQTHTTIELCLTSNLQTKAARSLDEFPYQALKAAGAAITINTDNRTVSNTTLTHEYELYQTYFKTTAADFLAFNLNAINAAFISEPAKQALRNRLHQDYAAYL

SEQ ID NO: 7919 - protein, 78 aa, Lactobacillus casei
MLIDQTDFIATQLQQIVYPNINAITETGVPITITTNKKQRDDPAFWQSISAILRAHLWVPVSKKYHELTDHDWLATPA

SEQ ID NO: 7920 - protein, 162 aa, Lactobacillus casei
MDQFSISNLADWLEAHNDELMAKTTQLDPTKVYAIVDYLKVLKKPAEKYLHMKQVDYYTTESDHKLNLPDDQSPLTATHDRIMVNHVDGSITDDQLNFTYNHEPVFDGGYAPQRDLNIVKYGLEVIGAVATSGHIETVSKALSPDAVLTLVLAANAFADHES

SEQ ID NO: 7921 - protein, 59 aa, Lactobacillus casei
MSTMLSNQKPYPIIDYLGRPIRLQLFVTYRLRIKNGYILALRRNQHQQALPNLLVKHAS

SEQ ID NO: 7922 - protein, 306 aa, Lactobacillus casei
LKRIRLWGIFLAIMGSSFWGISGPVSESLFDKGIKVSWLISSKMLIAGVVLMAVAFWKDRSAIMAPWRNRRDALQLIIFVLFGMIGMQYIYFKAVAVANAATATILQYLSPVVVLVFLALRLREKPRRIDLLTIGMAMLGTALVVTKGRLTHLAISPSAFFWGIMAALAAAAYTLLPAGLLKRHSPIVVTAWAQLLGGFLVDAFDPFWKQIPHLDAAGWAGYWFIVIFGTIIAYSVYLASLQFISPTAATLLDAFEPLGATLVSVAFLHMHLGFAEVLGGVLIILTVAMMAIVTPRGPKLEKRPDE

SEQ ID NO: 7923 - protein, 204 aa, Lactobacillus casei
MADTSDRTAEAKTEAALRRYQERKRYTDWVAKMSPELRAYHDHEWGVPVHDDQKLFELLSLEIFQAGLNWELVLRKRAAFNDAFHHFDIKQVAAMDEPDVDALLKRTDIIRNRMKIEATITNARAILKIQTEYGSLNDYLWAFVDGKPLVNRPKSLAEIPTKSALSVKIAKDMKKHGFAFVGPVIVYNYLQGAGLIDDHVVMED

SEQ ID NO: 7924 - protein, 148 aa, Lactobacillus casei
MDQEYDRLLVPVDGSKEAELAFSKAVKVAMANQAHLDVLNVLDTKQFIGSYGGMISGDAVYQLTQDAQEYLENLKEQAKSTGLTDIDIHIRFGNPKTVIATDFPHDHHNDLIVIGATGLNAVERVLVGSVTEYVNRTAPCDVLIVKTK

SEQ ID NO: 7925 - protein, 130 aa, Lactobacillus casei
MITNGVGSVLRQIRKSRGESIVEVAKATHTSPASFTKWENDQTIPSERSIRKLAEYYDVDPLDLLGVAYPDKYAKQKEQEKAAAEGSTIRIEDLIGNNSVLTYNGSPLSSGTKSLVAAFITGLIISQPEE

SEQ ID NO: 7926 - protein, 262 aa, Lactobacillus casei
LAPYVLNIKHGLNFRELGGYRTKSGQVIKSHKIIRSAKLSELSDEDLDYLADYGLISDVDFRSPEEQAAEPDRYPNVAEYHFVPVFPTDETKSSEQADALQKSFSRDPHAGFENMVKTYADIVKMPSAQKAYRQFFDILLSNDSESGAVLFHCTAGKDRTGMGAVYLLSALGVDGHTIRQDYLATNDLIQPMVEKNLAAARKRGATDALLANIRDLGTVSGAFLDSALATIDEEYGGMKNYLQDALQLTPAEKRDLRELYLQ

SEQ ID NO: 7927 - protein, 380 aa, Lactobacillus casei
MDLKETIKSHAKDLGIDKIGFTTADDFAALKPSLLAQKAAGHTTGFEHQNLDERLYPDKIFDQPQSIIAIALAYPSKIHDRPPRTGPKRGRFARASWGLDYHTVLDRKMDALMQFIKDTAATDTTIRFKPMVDTGELIDVAVAQRAGLGFIGKNGLLITPEFGSYVYLGEIITNIKFAPDEPMACQCGTCTRCIDFCPPKALLGDGRMNGQRCLSYQTQTKGYMDPEFRPMIRNVLYGCDICQQVCPFNKGKDFHIHPEMEPDPDTVMPELIPMLTLSNKGFKTRFGKLAGAWRGKKPLQRNAIIALVNLHDRSAVPHLLEVIENDPRPMIRATAAWAISELAAAPTAELTTFLKNAQAKETTEEARTEFQNAIDRIVQR

SEQ ID NO: 7928 - protein, 121 aa, Lactobacillus casei
LKLYQGLTQVQVNEEMADDAPDFNITTDLVKPLHYSPSELYRYLDAVLKPGSRHDQNNLKYVTDAAFIGENFDFNSVPFTAKLKDFESKMAFARNLVSDLNRHVSVNINTKDHAFELLFVD

SEQ ID NO: 7929 - protein, 180 aa, Lactobacillus casei
MQTKILTRMGLLLAVLIGLAFAPPITVGFLGVPIVLQNMGVMLVAMLLPKRSATVTIGMLLALAALGLPVLTGGRGGIAVFMGPTAGFMYGWLLTPLAYAGITHYLKQDSWVTKALGMTLGGVLLTELLGAAWLAATTNMTFVPALLSVLIYIPGDLLKMALSVLVVQQLTAVMPALNSK

SEQ ID NO: 7930 - protein, 134 aa, Lactobacillus casei
MRIDEVSKKFNLTKDTLRYWERIGLLPDIARNESGYRQYDEHALNWVYYIMILRKAGMSIEALSEFVKLLREGDQTIAARKSLFVEQRDHLMAQRDNINKTLRYLDYKIDHFEDHMLSYENEKLAYEGKLADEK

SEQ ID NO: 7931 - protein, 282 aa, Lactobacillus casei
METVKLNNGIDMPILGFGVFQVTDLNVAEQAVLDAIESGYRLIDTAQAYGNEEAVGRAIKRSGIDRQDLFIITKLWLTDTGYVATKKAFQDSLDRLQLDYLDLYLIHQPWGDVHGSWRSMEELYKEGKIRAIGVSNFEPDQLTDIAIFNDVTPALNQIEVNPWNQQLEPVKFMQNNDIQPEAWAPFAEGKHDIFKNPTLAAIGAKYNKSVGQVILRWLTQRGIVAIPKSVHKNRMIENFNIFDFKLNDDDIGKIAGLDMKESQFFDHRDPEAQMKIVGRRIK

SEQ ID NO: 7932 - protein, 185 aa, Lactobacillus casei
MDTPYPNMQDNPNMPFESGDDQPVWQALVKKMPPVTDLRVLVIHCGDGWFCRYALNHGAAAVLGIDTDTAAIQSARAVASSDRLRYRIMPDHWLKLLTGPYDLIVGAFNQSPAELRTITHVLSQLLSAKGQLIAAVAPPKQPTGDQLAVDELISSQLVINRWFQVTDKRLTQTAQLYLLLSSRVR

SEQ ID NO: 7933 - protein, 351 aa, Lactobacillus casei
MKKLLSTVLFSAVALSAVALSKPSHVSAATKDTESTTVSAPASDKTEADVTYNGGATTVWTSPTVGQQAKRYVTTGEHLQFVNSKKVYSEIWYETADHGWVPERYLSINTLQQLAPLTQKADASAAPTQTTSPAEQAAQSTSNNAQASSDAAAQSAAASSAAAASAAQAAAQQQAQQQAQQAAAASQAAAQQQAQQSAAAQQQAQQAAAASQAALQQQQAAASKAAAQQQQAQQPASQATVQTTQTAVQTAQPQQATQQQATSNQGTFKISFYDPSVMGSSLGYGGVAANLSVFPKGTHLRITMSNGQVLDRVVNDTGSFAAGNPRQLDVAMPNNQIPSAGILSATVEVVG

SEQ ID NO: 7934 - protein, 206 aa, Lactobacillus casei
MKLTVMQHADAEGLGVIQDWADKHSIETVTYRPDQGDPIAQLNPADIDGLIVLGGPMSVNDDLAWLAAERILIRSLNKLNRPVLGICLGAQQITKAFGANVYPMEKPEEGIGTVRTSDGTLLNVFHWHGEAMSRLPGSQLLYENDQALQGFKYHDRIVGLQFHLEVTPTMITAMGAAAGKPQGPVNEAILAPGHKVLNALLEQLFG

SEQ ID NO: 7935 - protein, 248 aa, Lactobacillus casei
MEQVKMYWETMKVFKAEPEMPKTQLISKPLPRTPATGTEMPQIAIRNVDVFQLMSELTGKVGVMNFASPVHPGGGVAFGARAQEEAIAKGTFLVPALEQHMADYYDQNCKQPNRGLFSSKLIYAEHVRQVFDDQGRRLPKKYVDIVTVAAPDRRVDPQLDDATAMNDIAFKVLQTLRAFKAHDVDQLILGAFGTGVFGNPIKPVAGVFRKALLLPEFAGAFKRVYFAIYDPQMRTIKSFAAALKGEDE

SEQ ID NO: 7936 - protein, 462 aa, Lactobacillus casei
MESGQIVPNLLVMLVTFFFAAFFVACEFALVQSRPSALEEMIDKGTGRKAKIERALRMVHNLNEYLSTTQVGVSLAGIILGWIGETTVEFLLVDLFGLTHLSLPNGSLHAVGAILGVIILTYLEVVLTEIVPKNISIDYPIKTLMLVVTPLHYFHILFFPFVWLLNVSATGIVKMMGMKPADEGNEAFSQAEILNLSKNAVTSGDMEQNDVIYMQRAFELNDKTAKDIMVDRTSLFVIDINTTVKEALRDYLTQGYSRFPVVANGDKDKILGYVYIYDLVKQGQVDPSVKVSKLLRSIINVPEVTPIHNILTQMIKKQTPIVVVVDEYGGTSGIVTDKDIYEELFGTVKDEIDDVSDEYIRKTDDPKVFRVSGKTTLWDFERFFHTNIKAFTDSEIITIAGFIMETHPDLKLHDKVKIDHFNFTVADFSRGFANWFDVTQDPKPVKQTVAEEVKEAKDKKQD

SEQ ID NO: 7937 - protein, 265 aa, Lactobacillus casei
MRLIKRLLLVVVILLVGLAPGTQLVEADTTPTIFVHGYRGTAFSTNQLIEGAEAAGVAKRSMVITVSPTGQLDVRGTLHTTAAPIIQVIFQNNTAGEEVDSQWLAKIFTMLHERYGVVKLNAVGHSMGAYAVIAAAMAQTPIELEKVVAIAGPYDGLLGWNDQPHQLQLAADGRPNLIRPEYARLLKNRTHFRAKSVLNIYGNVQDGTDTDTVVSVNSALSLGYLLRGLTKYQTLEVTGPHAQHSQLHEHNVTVDRAMLQFIWGK

SEQ ID NO: 7938 - protein, 342 aa, Lactobacillus casei
MNTEGAFQNVKVQSTHQRIEWIDVAKGLGIIAVVLGHFYPRNTTFYESLYWWHMPLFFMIGGFFVKPTTLPTLRDYLKRRFWPMFKQYFGYGVGLILLNFVVEQRTPAFTLDYLRRLLYGGTELNGYLSVFWFMTVYAFSSLLFSLLRGYMPKVWQEAVLMAGLFWLGFSYPNAEAALGFPIPGNLDLVLVALPYMFIGWWLFHYARQIVTKPWFVVVAVGLFAVLFTAQSRGQIDFLLYMKSHHLTDPLLAGWAPVIICGGLFAGAKIVSGTFAGNWLDRIGRSTLPLMYGHKAVGYVLEKFGDPNILVLVIAGVTIPLFLAYAGRCVRERWQGGGLYAFN

SEQ ID NO: 7939 - protein, 484 aa, Lactobacillus casei
LTPTDVNGHPYNRLLLVITLLIGTFTTFLTQTILTTAYPTLMADFHISASAVQWLTTGFMLIMGIMIPVSAWLLDKFNVKHLYLTAMTIFFLGSLICWLAGDFQMLLAGRLIQAIGVGMSMPTFQTVMFTIFLPEKRGSAMGLAGIVIGLAPAIGPTLSGWILLHHTWRALFAVIMPIAAGVVLLATYSMRKVLPTSHPKIDVPSIIASTLGFGGLLYGFSTVGDAGWTDTQVLISLAIGIIFVALFCWRQLHLKTPLLELRVFKSKTFTLSVILTAVAFMSMVGVEMVLPMYIQTIRGESAFHSGMILFPGAIMMGIMSPITGRIFDRIGAKRLAVAGLFLLVVGSLPLMTLTETTPLIYITTVYTVRMFRITMVTMPVTTAGMNALPTHLINHGTAVNNTIRQVAASIGTAILVSVLSVVTKGATPAASGKALDPIDYANALHQATLAGYRAAFAVSLVMAALGLILSFFLKNDAMDRRDAS

SEQ ID NO: 7940 - protein, 167 aa, Lactobacillus casei
MIILLLIIGAIAFFWAVVLMKPSRQRPLAIIVSGLLVLGPIALLSVNDLYHVGFTIDETTELQPLAPMNDQLQIISQPIGTAKKHIAYRYRISGDAIDHTVKPSATIKTKLKHGTIPQVAVTEQKLKYSNVFAAIMFAGSGEQGKTIGKVYTFTLPSNWQVVKSPKR

SEQ ID NO: 7941 - protein, 182 aa, Lactobacillus casei
MIILASHSPRRQELLKRIIPSFESHPATINERALPVLAPPEYVQSLAKAKGESLVPSYPGATIIAADTMVAFQGKLLGKPHSRQEAKQMITALGGQTHQVYTGLWVRLDNGTVRQQVVGTDVTFWPLEEAEVESYLQEDAYQDKAGAYGIQDAGALLVKSIQGDFYNVMGLPISTLYRMLLA

SEQ ID NO: 7942 - protein, 651 aa, Lactobacillus casei
MPKIHQLSATLSNQIAAGEVIERPASVVKELVENSIDAQATQIDVKVSAAGLQKIQVSDNGIGIDPADVATAFLRHATSKILTTRDLFNVHSLGFRGEALASIAAVADVTLTTATDSGIGAKIHVKGGKVEDQTTAAHRRGTDVEVSDLFFNTPARLKYMKSQQTELGKIVDIVSRLALANPGIAFTVSHDGNMVVRTAGQGDLRQTLAGIYGLPVARSMVDFQAQDLDFQVSGLTSLPETTRASRNYLSLVVNGRYIKNFQLTKAVIAGYGSKLMVGRYPMGVITIQMDAALVDVNVHPTKAEVRLSKEDQLSHLLSEAIRSRLAKENLIPDALDNLPKREHYDLDQLELTLNKISPKTAAPTPPQGTELHEETHDQPVNTPQAASTPSAETAPDLTMDDLDDRPIFSEPQRLAAWDQRYQQLDANVAPALVEDLPAQDLKRNEPAERFPDLTYLAQVHGTYLLAESSDGLYILDQHAAQERVNYEFYRQEIGKVSTDQQHLLVPIVLDYSAADAIDIRTHRDVLESVGLYLEDFGQNSFVVEHHPTWFKAGQEEDTIKEMVDWVLRDGKITVAAFREKTAIMMSCKRAIKANHHLDDKQARALIQKLPQCENPFNCPHGRPVLVHFSNTDLEKMFKRIQDSHESGEMQA

SEQ ID NO: 7943 - protein, 857 aa, Lactobacillus casei
VPQKTSDTPMMQQYNAIKAQYPDAFLFYRIGDFYELFNDDAIKGAQLLELTLTARNKSADDPIPMAGVPHHAVQSYVDILIDHGYKVAICEQMEDPKKAVGMVKRAVIQLITPGTNVDIKAGAAKTNNYITAVLPHAGGYAFAYGDVSTGELKVTDLKSKFALQNELSALATKEIVVPEDLTDDDAAMLKKSERLLSVQPDSQPTSEGSYVSQDLTDPVAAAVVQMLMAYLLNTQKRSLAHIQKAVAYQPSAYLEMDQDARSNLDILQNSRTGRKGDTLLSLLDATKTAMGGRLLKQWLERPLLDIGAISVRQNQVQDLLDHFFERSELQERLTKVYDLERLAGRVAFGTVNGRDLIQLQTSLDQVPAIQDVLSKLDDGSFKALRGKIDPVSDVAGLIRRAIEPEPPISVTDGGLILRGYNKKLDEYRDAMKNSKQWIAELEASERKATGIHNLKIRYNKVFGYFIEVTKSNLDKVPEGRYERKQTLTNAERFITPELKEKETLILEAQESSTALEYDLFQDIRDQVKAQIKRLQALAAQISALDVLQSFATVAENNHYVRPTMHAGTHDINVKGGRHPVVEHVLGQDSYIPNDVIMDQDTDMLLITGPNMSGKSTYMRQLALIVIMAQAGSFVPADAADLPIFDQIFTRIGAADDLANGESTFMVEMLEANAALSHATASSLILFDEIGRGTATYDGMALAQAIIEYLHDHVHAKTLFSTHYHELTSLSDSLAKLKNVHVGAVEEHGNLVFLHKMMPGPADKSYGIHVAKLAGLPSDLLNRADAILKQLEAATPEKTVPAAPSQVTDQQLSLFEEPKPQPKNSPILAKLAKFDLMDATPMDAMNLIFDLQKRLKKK

SEQ ID NO: 7944 - protein, 609 aa, Lactobacillus casei
MMHLKRLFIGRPLKSSEEGGQQLNIFKALAMLSSDALSSVAYGTEQIVLVLTTLSAAAIWYSLPIAAFVLVLLISLTLSYRQIIHAYPSGGGAYVVASENLGRNAGLTAGASLLIDYMLTVSVSVSAGAEAITSAIPALYGHQVAISLIIIFILMGMNLRGMSESANFLMIPVYLFVLVMTVMIVWGLYQVVSGAIPYKATSLVGAAIPGVSMALIFRAFSSGSSSLTGVEAISNAVPFFKLPKEKNAAKTLAIMAGILGFFFAGITFLNYWYGLVPMAKVTVLSQVAKETFGGTGIMYYVVQFATALILAVAANTGFSAFPVLAFNLAKDKFMPHMYLDRGDRLGYSNGILTLALGSAALITIFQGSTERLIPLYAVGVFIPFTLSQTGMIIHWFRHRGKGWIGKTVANLSGALISFAILVILFAYRLFDIWPFFIVMPLAIFMFYKIHDHYRKVAAQLRLPADVEEHEYDGSTVIVLVGNVTRVTRAALNYAQSIGDYVIAMHVSMDENPNKEKETQSEFRADFPDVRFVDIHSSYRSIEAPTIRFVDIVARNAAKRNFTTTVLIPQFVPRKKWQNILHNQTNFRLRAAFASRENVIIATYSYHLKK

SEQ ID NO: 7945 - protein, 113 aa, Lactobacillus casei
MKLIQNPIRLNASLHKMLPHTMRFLYSRKPVKYFELYTLGSVHVYYVEGFDQIDIVLTHDKRTIKDAEIDFVLEKLLPDTPKTELKIDHAAKSEIEHEVHRKLKVHDVVIIEK

SEQ ID NO: 7946 - protein, 545 aa, Lactobacillus casei
MAKEIKFSEDARTAMLRGVDQLANTVKTTLGPKGRNVVLDKSYGAPEITNDGVTIAKSIDLEDHYENMGAKLVAEVASKTNDIAGDGTTTATVLAQSIIREGMKNVTAGANPVGIRTGIEKATKAAVDELHKISHKVNGKKEIAQVASVSSSNEEVGNLIADAMEKVGHDGVITIEESKGIDTELSVVEGMQFDRGYLSQYMVTDNDKMEADLDDPYILITDKKISNIQDILPLLQEIVQQGKALLIIADDVAGEALPTLVLNKIRGTFNVVAVKAPGFGDRRKAQLEDIATLTGGTVISSDLGLDLKDTKIEQLGRAGKVTVTKDNTTIVDGAGSKDAIAERVNIIKKQIDDTTSDFDREKLQERLAKLAGGVAVVKVGAATETELKERKYRIEDALNATRAAVEEGYVAGGGTALVDVIPAVAALKEEGDVQTGINIVLRALEEPVRQIAENAGREGSVIVEQLKKEKQGIGYNASTGEWEDMAKSGIIDPTKVTRSALQNAASVAALMLTTEAVVADKPEPKDNNAGAAGANPAAGGMGGMM

SEQ ID NO: 7947 - protein, 93 aa, Lactobacillus casei; identical to SEQ ID NO: 1215

SEQ ID NO: 7948 - protein, 248 aa, Lactobacillus casei
  misc_feature (4)..(4): Xaa can be any naturally occurring amino acid
CAAXAMINTERMINALPRTEASESELFIMMNITYMSLQKHAFSVVGAYLVTFIANLLIFQFMPVGRLSLGIVTLISVIAMIAAAYSERQLVIANAIEAPGVLAPQQRVFWGVIGIAGVLAAQLVGSWLEMILFKMPQTNSQIHQQLSSMTTNPWYFLAIGLAIPVLEELAFRKVLFGNLVNVTGVFGGALIASLLFAVTQPGGHWLSATLVGLVLAYDYRHTGAISTAIIAHVGALWVVWLYYIAHAL

SEQ ID NO: 7949 - protein, 352 aa, Lactobacillus casei
METRSNHRHRQPPKRFRWGRLIGLIVIVGLFTVGAYALRLYSQAKYAIDNTYHATKHVSTDIAQKKPFAVLLLGVDTGAEGRVEKGNSDTMIVAVVNPKTNKTTMVSIPRDTAAELIGTKEFNMQKINAAYNVGGSDMAINTVSKLVNVPISYYLTINMGALEKVVNAVGGIDVDVPFSFQDPYTGNQKFKKGRMHLNGNMALAYSRMRHADPEGDYGRQKRQQQVIKAILKKAVSVGSLGNFTKLMDTISKNIATNLSFADMQSIFMNYRGAAKTITTDHLKGVNAWVGDGAYQIASDAEMQRVSDKLRKALGLQTETISNEETKQNAKNTQFDFKATTDQNYIIFTPYDR

SEQ ID NO: 7950 - protein, 347 aa, Lactobacillus casei
MGDHQLLKLVRIRHKALIRVMFVFVVLLAVFNLGDTLKNYQSQQKYMMNPTEYYAAQNQAAKHHSEIYGNKSYAGYRDEQRFLIEPQRNRLYSPFLINRIMTVISYIVPLLLGLIMAGADQASSFNATLFKSRFKRKRLFDTRYWYGLACLLGTTTLGISLTLFGYYAGVPAAYVGISGLNILGLFMTNLAVNSFMFTAGIAVGSIFASLFGMFVFGLLGGWLGMSAIQRFVTYTTIDKRSYRAFLPHGDQLFLFFFVMALIASAAGYWITRWLFDRISLENEGDILLLPKLRWVIFVYALIVVPYNFGDWLFQNELLSYSVSIIGVLALGLWWLHRERAQEQLMVR

SEQ ID NO: 7951 - protein, 295 aa, Lactobacillus casei
MSLIVTKLQKRIANQEVLRDITFSLDRGQVVGLVGPNGIGKTTIFRTVNRQYIADGGTVTLDQHDLTKESPQQAAIFYLDQQHLFFRKYALAKIGTTYALLYPSFDQTAFLHLIKKFGLAGGQRFQGLSKGYQALVMVAMALASQAPYVFLDEPFDGLDVLIRERIVNLVVDAVADGQRTFLIASHNLAELDGLSDRVLFVKDGRISRDLTLENVRQQAVKLQLVFRTKEIPAVIKQHGRILNIRGRVIEVVFPDFTPDVQAALQAEQPVLNESLPLSLSDLFKVEFRKKHAEVG

SEQ ID NO: 7952 - protein, 122 aa, Lactobacillus casei
MATESYTHLAYYERLVLQIKTRILQGIMQPGDKLPSVREMAKQEQLNPNTVAKAYKQLEADGVIYVEPGRGTFVAEPLKHANSRAVAAFRPKFDAIVVEAQSLGISLATLQAWLTEKEEHRV

SEQ ID NO: 7953 - protein, 217 aa, Lactobacillus casei
MAETIIPKATAKRLPVYYRYLNFLANSGTTKISSTELSDAVKVDSATIRRDFSYFGALGKRGYGYDVNDLLKFFKKILNQDRLTNVGLVGVGNLGHALLNYNFRQANNIRISAGFDINPDLAGTIQSGVPIYPMDEMIKQIKDQQIEIVILTVPIDAAQHITDDLVKAGIKGIMNFTPIRISVPSYVRVQNVDLATELQTLIYFLEHYGPTLNEPEA

SEQ ID NO: 7954 - protein, 650 aa, Lactobacillus casei
VIILQAQQVSRSFNGNELFANVNLEVQDGARIGLVGPNGIGKTTLLEILTGIAPPDSGQVTTMKNLSIGYLAQNSGLDSDKTIFKEMLTVFAPLQAMARQIHALEAKLGDPKLIADKPAFAATMKQYDQLQHDFNEQNGYGYEAEIRSVLHGFQFGEDTYDKPVGTLSGGERSRLALAKLLLEKHDLIILDEPTNHLDIETLSWLEGYLKTYPGAILTVSHDQYFLDHVVTEIYELDHHHATHYKTNYSGYLQQKAERQAQAWKAYTKQQEEIAKLQDFVDKNIVRASTTKQAQARRKQLEKMDVLEKPTGDDKSVRFNFTPNRPSGNEVLKVDQATVGYEADHPMAGPIDFQVNKFDRIALIGPNGVGKSTLLKSILGKIPFLSGSAKFGANVDVGYYDQEIQQLNPKNTVIDEIWDEHPMMPEKDVRSVLAAFLFGPDDIQKPVSALSGGQKARLELTKLALKHDNFLVLDEPTNHLDINSKEVLEQALKDFNGTVLFVSHDRYFINELATNVIAIAPTGSTTYLGNWDYYQEKLAETKAEAEAAAAEQPTAKTETAGATSYQQSKEDARATRKLQREVADLEAQLQKLGNQATTIQKEMTAPDVLSDYVKMQKLQTKLEAVQKQTTDVENAWEEKSIELEDMQTADK

SEQ ID NO: 7955 - protein, 111 aa, Lactobacillus casei
MIPIAEKTIMLVCSAGMSTSMLVQRMKKAAAADGMDVDVFATAAADADNKLASEPVSVLMLGPQVRFMESQFKAKADAKKIPMAVIDMKAYGMMDGEKVLQQAIGLLDQKV

SEQ ID NO: 7956 - protein, 340 aa, Lactobacillus casei
VAARELILAFESSCDETSVAVVENGNKILSNIIATQIKSHQRFGGVVPEVASRHHVEQITLVTDAALKEAGVTYTDLTAVAVTYGPGLVGALLIGVTAAKTIAYAHHLPLIPVNHMAGHIYAARFVKPLTYPLLALAVSGGHTELVYMKAAGEFEIIGDTRDDAAGEAYDKVGRILGIPYPAGKEVDRLAHLGHDTFHFPRAMDKEDNLDFSFSGLKSAVINTVHHANQIGETLSREDLAASFQAAVVDVLVHKTQKALTHYPVKQLIVAGGVAANQGLKEAMNEALAVHFPDVDVIVPPLRLTGDNGAMIGAAAHIELAKRHLASENLNADPGLSFAHA

SEQ ID NO: 7957 - protein, 177 aa, Lactobacillus casei
MLRKFRSWFDRTTPDELQFESRTINVRNKEYLLRRMTEADVDAALAIERRIYHDTPWDRYAFFSELRKVRHSLYLAVEDAGQLVAFVGTWFTMSEAHVTNIAVDPAYQHMGLGRFLMQFMIGRAIEYGSEKVTLEVRTNNDIAKQLYHSLGFQDGKVKKGYYVSNHDDALDMYRPLP

SEQ ID NO: 7958 - protein, 240 aa, Lactobacillus casei
MRLLALDTSNEAMSVAVLDNDRLLAQTTINHERTHSEQLLPTIDDLVAASGLQPEDLDKIIVADGPGSYTGIRIAVTTGKTLAYTLNIALVGVSSLEVLAANITDTKAMIVPIMNARRNNVFTGVYQWDKGNLINVVTDRHVPLTLLLTELTTLRQPVIFVGTDAAMFRGQIIEALGGLAHFAPDWLNLPQALRLGQLGKDLPPVSVYDFVPRYLRLTEAENNWLKAHPGKGHDVYVEKV

SEQ ID NO: 7959 - protein, 203 aa, Lactobacillus casei
MDLLLLGLIAVALAGTGLWAWSLERKIVAMQLTTHKMMYPNQVRTGRKTYVRNLYRENALAQRIRRVGLTGSWISGLAFAFAIGNQFYNELSHLPLIRRLYIFTADYLTTRNQALWVLAISAVVAGFAWMWLAKWLHDQLLAANEATGIQSAADLYWTPESIIHQRLWLKILLQILLMIGSILILLAALNGELPNPGEAWLSL

SEQ ID NO: 7960 - protein, 172 aa, Lactobacillus casei
MQVLSFSSPKLSTRNIVYMAMLMAMQIVLGRFSFGTPWLKISPAFFATILMGYYFGPWLAAGAAALNDQLSIMVFNPGANFPGFTLSAAIAAMIYGMFFHGKKVTVMRTLLGVGLVLLISNVILTTLWLNMMGTPWQGIIWPRTIKNVVMLPIQTALSYGTLKAVERIRPHL

SEQ ID NO: 7961 - protein, 324 aa, Lactobacillus casei
VTKHILVLHTGGTISMTETRDGDIMPSKHNPLLGADSFVPAGVELTSEEIFNLPSPHMTPERMLTLVKRIRQAEKDGADGVVVTHGTDTLEETAYFLDLTLDSAMPVVVTGAMRSSNEIGSDGLENLQSAIKTAASDESRNKGTLVVMNDEIHTARFVTKTHTTNVATFRTPTFGPVGLVTKDGVRFFQELINQEVCAIDHLVDHVFLIKAYAGMDGTLFDALPENIHGLTIEALGAGNLPPATLPAIQRLLDRHVPIVLVSRCFNGVAQAVYNYEGGGVQLKKMGIIFCQGLNGQKARIKLQVGLSDGKRGQALADFVDNAVS

SEQ ID NO: 7962 - protein, 247 aa, Lactobacillus casei
MGKVYEEDYRIPGFLGDRFGRAGLANMMNVMLEVSERQLEKLHAGIDAISEFHAGWVITQYHMEIQRMPKIEELLRVGTEATTYNKYFTYRDYWIDDAQGNRLVSVSSNWVIMDLRTRKIVDVIPELVERVGAVSDRKIKRFPRFKKVDHPDGEETFHVRYFDIDSNGHVNNAHYLEWMENSLGYDFLSSHTLRGADIRYEREVAYGTSPKAQFQADPDDATRTLHRVTTDGEVNAEAQMIWDDFKA

SEQ ID NO: 7963 - protein, 286 aa, Lactobacillus casei
LEQQRSFGSHTTGTLYLVPTPIGNLDDMTFRAVAILKTADLIAAEDTRHTQMLLNHFAVTTKTISFHEHNTQMRIPELLAKLEAGKTIAQVSDAGMPSISDPGKELVHAAIEHGVPVVPLPGANAATTALIASGLSPQPFLFYGFLPRKSGDKQRILAKLATEPATLLFYESPHRVGKTLAAMLEAFGDRQAVLARELTKKFETFIRGTITELQTYAENELKGEFVIMVAGAPDKPVVKSAAPFKDQVAAIVATGAKPNAAIKLVAKQNGVAKQVVYDAYHDLDRA

SEQ ID NO: 7964 - protein, 112 aa, Lactobacillus casei
VEKKELYDGFLVLEKHAQQMLKEIAAMKDDMAETLERNAELEIENKHLRQHLAELEKDDNKTSDGGVELSKSKQNLESLYNEGFHVCPMFYGQRRVNDEPCAFCLDIIYGEN

SEQ ID NO: 7965 - protein, 325 aa, Lactobacillus casei
MAKFLIDSLQPKLVAQFARIIDRKQLAQSYLFVGPKGAGKLELAEWIALRLFCQNVQDGAPCGECPECERILNHNHPDVMVLKTSTQSIKVDDIRNLKQEMSKTGVEGNRRVFIVEDADKMTAGAANSLLKFFEEPVPGMTVILTASSKNQLLPTILSRAQVITFQSPDRQALIAKLEEDGANPQLARVAGRLTGNVSEAQELLTAEDFQDRVNRVFQLLDRLADHDPESFVRVQTQLLPVAKDAAAQRQVLALIGLAYADALNRHFEIAATQQLDIPAVAALAKLSSRQLTDDLQAILTAQVRLSQNVTFQSATEQLMLKLLEG

SEQ ID NO: 7966 - protein, 109 aa, Lactobacillus casei
MKLILAIVQDKDSNLLSSQFIDANIQATKLSTTGGFLKAGNTTFIIGVADERVDDVLKIIKETSQTRQQFMTPPVNLDATSDSSMAYPVEVQVGGATVFVLPIESFHRF

SEQ ID NO: 7967 - protein, 214 aa, Lactobacillus casei
VTGTFITFEGPDGAGKTSVLEALIPRLKSQSQAALHLTREPGGAKISEKIRDVILDPANTEMDARTEALLYAASRRQHLVEVIQPALAQGDIVICDRFVDSSVAYQGGGRQIGTQAVLQMNQFATAGLEPNLTIYLDVPVQVGLDRIAAHQHERQYDRLDQESLAFHERVHSAYMKLVADNPTRIVTVDATQPLAAVVTAAEAAITKRFPSLFG

SEQ ID NO: 7968 - protein, 87 aa, Lactobacillus casei
MFGRKRIKVKEEKDEELMMLVYRVRDQMAAQRKLVATFREVDEETKSQVALEAALFDFLYREARTRKIKGEVVAKVAAEQIAEFRDL

SEQ ID NO: 7969 - protein, 199 aa, Lactobacillus casei
MQYPEPISKLIDSYMRLPGIGAKTATRLAFYTIDMDKDDVTAFAKSLVAAKEDLHYCSICGNITDEDPCSICRDKSRDQSTILVVEQPKDVMSIDRAQDYHGLYHVLHGVLSPIEGRGPEDLNIESLLKRLKTNTAVKEVIIATNATPEGEATAQYLARLIKPAGIKVTRLAHGLAVGSDIEYADQMTLMKAVEGRTEL

SEQ ID NO: 7970 - protein, 102 aa, Lactobacillus casei
MRGMGNMQGMMRQMQKMQKEMQAAQKELYATEFEGKSASDMVTVKFTGEKVMKDIQIKPEAIDPDDPDMLQDLILEAVNHAMSEIDKQTQDKLGKYTRGLPM

SEQ ID NO: 7971 - protein, 566 aa, Lactobacillus casei
VSYQALYRVWRPQQFKDVIGQDAITKTLKNALITGQTSHAYLFTGPRGTGKTSVAKILAKALNCLNLKDGEPDNTCEICQAINDGSLTDVIEIDAASNNGVDEIRDIRDKAKYAPTRARVKVYIIDEVHMLSSGAFNALLKTLEEPPAHVVFILATTEPHKIPATIISRTQRFDFRRITPEDIVKRMRFILDDKKITYDDAALKVIAKAAEGGMRDALSILDQVLSFGDNHVTTEDALDVTGGVTTAVLGKYLAAVLAKDHAQALKMIEDLLAAGKDAGRLIEDLIEYLRDLLVNQQAPSLLGDLEKSLLDDQFKILSENFKPAQIYHMIDVLNNTQQQLRMTNHPEIYLEVATVRLSETAAPAAAPVAAEPADTQKLDQLSAKVKQLSDQLKRVEANGGTVPPPTRTRKHVKAKASHVNRKAIYPILGAATKQDLTNLKDVWPDLLGMLSITKRAMMKVSEPVAASPDGVIVSFDYDILVERAMNDAALMTELENGLQKLTGKQPKIVLVQSDVWPTIRKDYIQELKAPATKGKSADTKPKTPPVVNKMTELFGKDAPNVTIKND

SEQ ID NO: 7972 - protein, 171 aa, Lactobacillus casei
VAETEESDINQYMEAALAEARKAAAIGEVPIGAVVVHEGQIVGRGHNLRETSQDATQHAEIIAIQAACRKLGTWRLEDCQLFVTLEPCPMCAGAMINARIATCYFGATDPKAGVAGTFYNLLEDSRFNHQVAVVGGLKAAASAELLQSFFRTIRAKRKAAKQAGQTRENQV

SEQ ID NO: 7973 - protein, 108 aa, Lactobacillus casei
MTKSKYLAAGAIAAAVLATGAFVCAKNLTEYFERRQQRKQVEGFVKKIFGDSDRVQSILDKLSDEDVASLLRVSDKLRSLKDSASEYAGSAREQGMAALDRLKSALNR

SEQ ID NO: 7974 - protein, 198 aa, Lactobacillus casei
MQHYYTNDPDLAHDEHSFDFELGGHVLHLTTDNGVFSKHTVDFGSRVLIASVLAASLPEGPILDVGTGYGPIGLALAKYFPERQITMSDVNERALALAKQNATDNGITNVSIVESSMYDQIDGQFGVIVTNPPIRAGKAIVSGILAGAAEHLLPGGQLYAVIQKKQGAPSALKLMKATYKTAEVIKKEHGYYILKASQ

SEQ ID NO: 7975 - protein, 881 aa, Lactobacillus casei
MNENTGTEDAEKMKRLFREVGTFLKKHLTTLKVLFVLAVLVFVIVQVGRISQDLSGEQMRASLATQSPVSLLILLVVGLIAVTPMLIYDFVITELLPGHYKRRYVVKSGWIVNTFTNIAGFGGLLGASLRANFYHEKATQKQVLFAISKIALFLLAGLSLWSMIGIVVIFVFGIGQEFSNYWIWLVGGAAYFPLLMLVTHLRNSEFFADMPLKRQLRLTLGSFLEWGSCAAFFLLIGYFLEVHVPLLSILPLFMVANVIGVVSMVPGGLGSFDVLMIVELGQMGLDSNVAVVWLLFYRLFYYVIPFLIGAGLFAQDAGKRLNAYLEGLPVQLIRKAAFGFLVVFLYFSGIMLLLRGVAPDLAFSNTLYQRLYPYTFLFLDRVTNVVVAFLILGFGRGIASRVKRAYWPTVIVLIVAMVASLREDNHLRFIIFLVLVVLALILTRRELTRERLALSWGNKLIDGAVFGMTFIFYAFAAFYNAPAIHHRRVPDVFLFPSERMFFTTLIGVMLAALTVYLIFRYLSAPTKDLADPYDEERLKAVVEKYGGNEVSHLALMRDKSLRFYQVDGEDRVFFQFKKKADKLIIMGEPIGDETQMAAAIGDFMKEADKQDMSLVFYEINENLTMKLHEFGFDFMKFGEEGYVDVTTFTLAGTKRKGERALMHKFEREGYTVELLKPPFDDTLMHELKAVSDSWLDGRSEKGFSLGFFDEHYLNEAPIAVVHSPEGKIVAFASDMPSGNHEVTSIDLMRSSTDAPSGIMDEVFINLFRLAKERGYKYFNMGMAPLANVGTSNYSFVEEKIAHLVYEYGYRFYGFQGLRSYKNKYVTEWVPKYVAYRKRTSLLFTLLQIMMVVSQKVTLTTSNSWWPKRLAWVSRLGQGIDK

SEQ ID NO: 7976 - protein, 137 aa, Lactobacillus casei
MLMQAHFYPELSVYQDTQIGALKGIALKLTNDYDFDYQEVLSSLLASAAEPTQTMGDQVVLTYGHVSKLTEPIVIGFDFGKSLPWAGNHQISGAVVLLVPVATDDVTIHEWLATIAAANDPDQSLESMTQSATAAIA

SEQ ID NO: 7977 - protein, 311 aa, Lactobacillus casei
VANIHDIARLSGYSTATVSRVLNRHPYVSASARAKIQAVIDQLDYVPSTMAQNLSAGKTRTIGVILPHTDHPYFQQLVTGILNAAMAGNYHAVILPSRYDQNLEETYLEALRRHAFDGLIFTSHGLSLTTIAAYQKYGPIVVCENPGRVKLAAAYAERTPAYRKAFKWMQAQGYLKIALLLSRPYAQSATSKLTINSYVDVFGQRPPHSLVVYQMRTFQDGYHAGAELAPQHPDFILGNGDDIAAGVRQYFVDHHLPVPPLMGQEDQLSSHLLNMSTIDHHVTAIGAAALKLALRAEVAQTVIQSDLILRD

SEQ ID NO: 7978 - protein, 1955 aa, Lactobacillus casei
MQTKKKGLSILLASTVALGALAVLPVGEVQAKAAISQQTKEKSLAKTVATGQTATDTTSAVTNQAIATQLAAKGIDYHKLNKVQQQDTYVDVIVQMSAAPASENGTLKTDYSSTAEIQQETNKVIAAQASVKAAVEQVTHQAAGESYGYVVNGFTTKVRVADIPQLKQIAGVKTVTLAKVYYPTDAKANSMANVQAVWSNYKYKGEGTVVSVIDTGIDPTHKDMRLSDDKKAKLKRADVEQFTKTAKHGRYFTDKVPYGFNYADNNDTITDDTVDEQHGMHVAGIIGANGTGSDPTKSVVGVAPESQLLAMKVFTNSDTSSTTGSSTLVSAIEDSAKLGADVLNMSLGSVSGNQTLADPEIAAVQNANESGTAAVISAGNSGTSGSATEGVNKDYYGLQDNETVGSPGTARGATTVASAENTDVIGQSATITDGSGLKLGPETIQLSSNDFIDSFDKKKFYVVKDATGKLSIGGASDYTADAKGKIAIVKRGDIAFTDKQKYAEEAGASGLIIVNNDGTATALTSIKLDATFPTFGLSSVTGQKLVDWVTAHPNDELGVKIGLALLPNQKYNADRMSDFTSYGPVSNLAFKPDITAPGGNIWSTQNNNGYTNLSGTSMASPFIAGSQALLKQALNNKDNPFYADYKQLKGTDLTDFLKTIEMNTAQPVNDINYNNVIVSPRRQGAGFVDVKAAIDALEKNPSTVVSENGYPAVELKDFTSTDKTFKLTFTNRTKHELTYQMDSNEDTNAVYTSATDLNSGVLYDKKINGAAIKPDREIVVPAGQSVQVGFTLSLPKSFDQQQFVEGFLNFKGSDGSRLNLPYMGFFGDWNDGKIVDSINGQTYAPASGNYGTVPVITSRKTKNQFIGGLVNDASGNPTIDEKAIAISSSKDAIYNGISMQYYLLRNISNVQVDVLDGQGNKLTTLSSSTNQTKTYYDANAGMYIYYQAPTWDGTYYDQRDGNIKTAQDGSYTYRLSGVPEGGNKRQTYDVPFKLDSKAPDVRNLSLTSKNENGKTAYYLKVEAKDELSGLDAAKDIKTSINDVTNLDGTFTTTGTTADGYTQLEVPLTDKQAQALGEGDNQVEVYLTDNASNPTYQSAAVQKPGSTTFSLIVNGGGLPDKISSTTENYEAGKQGGKYTFSGTYPAPVYGTYTDAQGKKHDLTTSYDAATNSFTASMALTADDYATKVDLYADKAHTQLLKHFDTDVRLTAPTFRDLKINNNQDQTSESTVKVTGTASADTKQVTITNGSTKTPVTLDNKHQFSVDVPVNYGDNTLKVTAEDEDGNTTVKEQKVNSTYDADVLKDAVTFDEGVHFGANDLSNIKQVKYYDAKTGIATITGKVKHPTTTLQVDGKQVPIKNDLTFSFTLNLGTAGQKPFGVVVGDTTQNKTFQEALTFTLDAIAPTLSLDQPADKPVYTNDPNFGITGTATDNVNYLELAINGSNVASQYADVDMNSGKPGHMAIDQTVKLLEGKNVLTVAVTDSGKNVTTKKLTVYYEPKKTLAAPTVAPSTTDPAKQVTLTAKAAATGETVQYSADDGKTYQDLPANGLNVTANGTFKFKAVDLYGNESPAVDYVVKNIKTDDPAQLQQAKTALQDLISKARTTAATGKYLDASVTALNSAVTTAQAALNQADATIDSLATATNQLTTALNQLTLKLPADQQDALLNKLQSAKDVLGTTFGGQTNSATGMTFNAELDALTAETKAGTSTADQLDANFNKMLDAALTQLAKTVKDGTPASVGDTKDTTTGLTWYAEIDSALKAGTTATTDTQKIAQLQGLFGLKTKIAAAVEAAKQAGDNGSNSNNGGTTNGGSGSSSNNGGSSGGDTGGDSNNGGATNDSNNGGGETPNPGTGKGQTPGDGGGTPSDTKQQPSTPTGDGTQPLGTAGKDDTTPQPPTSTGQGGGTSSHGTNQQASKKDTLPKTAEVTQTAGLAFLGAFITSIVGFLGVNRRRKEH

SEQ ID NO: 7979 - protein, 300 aa, Lactobacillus casei
MKNKLRVQGLLAMMAASLVLLTGCQTKQADGPTVATYSGGQVTQASLYKELKQSPTAKTVLANLLIYRALDHAYGNSVSTKAVNTTYDSYKNQYGENFTSFLTQNGFSKASFRQSIRTNLLSEVALKKLKKVTNSQLKEAWKTYQPKVTVQHILTSDEATAKQVISDLAAGKDFTTLAKTYSIDTATKDNGGKASFEASSKSFDSTFKDAAYKLKNGDYTQSPVKVTNGYEVIKMVNHPAKGSFESNKKALTASVYAKWSRNSSVMQRVISQVLKDQHVTIKDKDLSDALDSYKQSVAKD

SEQ ID NO: 7980 - protein, 36 aa, Lactobacillus casei
MDPVKAGFFCFETYGIDSTKPINLYTSKKHPAQPQP

SEQ ID NO: 7981 - protein, 122 aa, Lactobacillus casei
MALDVDGIIAQLKDASILELNDLVKSIEDEFGVKAAAPVAAGAAAGGDAAATKDTYDVELTEAGQEKVKVIKAVREITGQGLKDAKGLVDAAPKVIKEGLSEDDANKIKEQLEEVGATVTLK

SEQ ID NO: 7982 - protein, 168 aa, Lactobacillus casei
MSEQAIAKKAELVKTISEQFKNATSAVVVDYLGLTVEQVTALRKELREAGVKMEVLKNTYLRRAADANGYEALDDVFKGPTAVAFSNDDPVAPARIMAKYADQFDALQIKGGIIENKVASLDTIMEMAKMPDREGLLSQLASVLQAPVRDFALVVKAVAEAKDEEPAA

SEQ ID NO: 7983 - protein, 410 aa, Lactobacillus casei
LPSKLKSLEPWQQNLAVLWLGTFIAGMGFSEVSPFISLYVDQLGDFTKGQLSIYSGITFGVTFMVVAIVSPLWGRLADRRGRKLMLLRSSFGMAIIIGACGFVHNVYALIALRFLQGLAAGYIPNASALIATETPKAKSGTAIGILTTGYVSGNLIGPILGGFLAQTFSIRLTFIITGALLLIVFVLSLTMVHEHYTPDPRLLKKEKRPGLLTQVSNPKAIMVLLISTAIIQLGNMSIYPIISLYVKELMHNVGPITVVAGIIAALPGISNLMAAPRLGQLGDRIGSGKILVSGLIFAVIMYIPQGIVGSIWALGFLRLMIGVSDGALFPTIQTLLSKLTPVSYTGTVFSWNQSAQAFGSMAGSLAGGFISNIFDYNGVFIFTALCLALDLVMVWTFIPHIWSSRPQQQE

SEQ ID NO: 7984 - protein, 273 aa, Lactobacillus casei
MINWQPGAGRSVTPAELQPLLKGEDQWTNQLFGNKAAIIRGFPQAGPLQYAVAVWQNTYHKRALYFNVVGRNIRLAELIPMLKQLAGQHDRLQFSSYDFSSDITQQLRQAGFQVIRHTAMGTYRTLQPTATIRGIKSRSQLTATQWQSVVQLSYQKYVSAHTVNPATMTQAQFEKELSDADSQQPGFWVVGNRVRAYAFWFEDEPGELISAWLGGVKQADILRLMQAVLPLVQANYRVVNGEFDDTDPHAWAVYRRLAIPDPHPLVTWQLLLH

SEQ ID NO: 7985 - protein, 176 aa, Lactobacillus casei
MKKITEWYYGISLKDRFKQRTYDAIMGRNMLTAELMLLIASATAIFIDANSLKMITASTWILLLVTVIIGLMNTVSLHYYRLQVIEVDTPEAYHQYVWLAVARGVLSALVLAVAIFAIEMAYEAAMDMNPLPQYYLTNHFWIGVMLPIAYGICRFGYGFLHLHGTWDHKKDTEDND

SEQ ID NO: 7986 - protein, 407 aa, Lactobacillus casei
MTKKAPSHARLIVGIGIAWLFDAMDVGMLSFVIAALHKEWQLSTVEMGWIGSVSSIGMAVGAILFGMMADRFGRKAILILTLLVFSIGSGISAFATGYGIFLVLRFIIGAGLGGELPVASTLVSESVPVEKRGRSVVLLESFWAAGWLLAAIISYFIMPVWGWRVAVFATGLAGLYAFYFREGINESRAFKKVARPSLIKTLTTLWHPPYVRSTIMLWIVWFMVVFSYYGMFLWLPSVMVLKGFSLINSFGYVLIMTLAQLPGYFVAAWLIEKWGRKLVLSLFLLGTAASALAFGMATSLPMLLTAGMLLSFFNLGAWGALYAYSPEQYPTIVRSSGSGMAAGIGRIGGIVGPLLVGHLLGANWSVTSIFAIFTASILIAIVAIVFLGQETMGVKLVDSIETAPSKS

SEQ ID NO: 7987 - protein, 207 aa, Lactobacillus casei
VRLRSQQLLSPMPVVQVPVLAKQVMHRRQLQVTQATPAPVLAKPARTRHRQVQVPVKQTAMQAVRQVMQVMHPRLHPTTQVIAGSSLMQAPHPVPQAKQAAPQARQAANHQLLRLLQAMQAIRQALLQALIQRQAVRQVPQAVPPAPHRAPQTPATAVPQAAIPVPQVPQQALHLVLKVLQAVLQVLLLPMTQQLPVPQVLQAQITR

SEQ ID NO: 7988 - protein, 120 aa, Lactobacillus casei
MQARLPAPQVPQTARLVTPIANHRLLLPLQVMQATRQALLQALIQLQAVQQVPQTAPRVLHPVPLTLVTAVRQAVTPVPQVPQQALHLAPKVMQAMPQVLPLPMIRWLPVLRALQAPTIR

SEQ ID NO: 7989 - protein, 106 aa, Lactobacillus casei
MQARLPAPQVPQTARLVTPIASHRLLPLQQVMPVIKQASLRAPMLKQVAQPKMLIVHPVPHPVPRRMVTAVLPVPSLVPQVLPRAVPRVPRVKQAMPQVLQPLMIR

SEQ ID NO: 7990 - protein, 202 aa, Lactobacillus casei
MTKLPVTRMPLQAVPLVLHKVLQQRRVMQVVPTVLRPQRMNMRVLQVQAPVKLVPMQTMQSPVPVTQRVSQAQPTNMQAPLPQLLPVIRRIAGSSRMQMRLRVLLRKQIAMQAWPIVPPQLVQRLPVMPVTKLRPLVVPMLSQVAPLRPLMPTRVLQPVLPRLVTAKLLLATPQLQVRLQAAPRVLSPLPVMPPAKQLPMIH

SEQ ID NO: 7991 - protein, 183 aa, Lactobacillus casei
VTPVVRVPVLVKLIVLRPRRISMRVPQVQAPVKLVPMQRMPVPVPVMPRVNRPQLISMQAPLPQLLLSIQRIAGSSRMRMRPRVLLLKQIAMQAWLIVLLRLDQLLPVMPVTKRRQLPVLIQMQVLLQVLQTVLPVLRAAHPRLVTVRLPLVTLLLPVRLQTLPRVLSPLPVLPRAKQLPMIH

SEQ ID NO: 7992 - protein, 498 aa, Lactobacillus casei
MIYMVGENVFTFNSGTEFSQMQRLKAFKRNGIEAKLLVRNYNRFLYRDASRAGLAKDDYINMYDYFQGVVGLERKKQELRLLDSIPLTKYHVVGIDNNLTTIDLLGRTIAKIAVMPETVGLVGSIDYFDRFGNKELTEFWDWRGFKSMEQNYNPDETVAAQKFFDRQGHVVLEIVHMNKNGKLAPTLWKLMNYHGHDYAFDSEDSLFLFFMNEITKTTPGLMISDRRTLDAAVKQVAHATGTIAYIHEGDLFIEGEGKKKVPNHIYDEALDEQKPFTAVFFATREQAKSLSSKWPHLTIKSSPDTFAEVQADNQSEPEHPHLTYIGRLFPDKHIAELIDAFEQVHQARPDAELFLKGYFSDDDYHHEITDKIHKKKLDDAVHLVNYSNDNHDILAKTTVFVSAAKSEAFGMNSLEAMAAGVPVVAYGCLFLKNNLLINDQNGLAVDNMTPSNLGKAALSVLQDEQLYHRLQAGALKTAAQHSEKAFVDEWKSGLSEFL

SEQ ID NO: 7993 - protein, 517 aa, Lactobacillus casei
VNYFINFGMPASKSGIEHAELKRKSLFDKHKEAYCFLLRDWSRDLHTNTANAGITDEHLINMFDYYQDTCHVDQAQLLPEEVDLGLKDLKYDDEYKRNRVLVSRADGRLAARINYVRETRQVVSTELFDGVENLYQVAFYDSRGFKSLIQWYTPDNKIGNEEWLTLDGRPVIKAFNKKGEDGKIKQTGWILTDRKGKRFQFDTIDAFFEHFINDVNESGENVFILDRSLLADEALIHLDKPAYTVMHLHNSHAGDAQRPMDSVMNNNYEYALVNGAKYSAFVSATKKQAVDVTKRFPYITKSFDIPVGIVPDDVLNRQRILSKNRIFGKVIAVARIAPEKNLDNLVRAIAIVHKQTPEVTLDLYGYPDATNNYAEKKKIEKTIKELSLEDVVTFKGYTENLESAYNTAQIFGLTSIMEGFDLSLLEAISHGVVGVTYDVNYGPNEIVEDGVNGYVTPYGDIKALAEKIQSLFADKDKMQQMSTNAYESAKRYSEENVWHKWQNLLQDAEKTEGGVAK

SEQ ID NO: 7994 - protein, 461 aa, Lactobacillus casei
NADPMAYQTVDPNTNTLEKTYANTTPAQIGEMLTTGHAFYKEQRNLDPATRAATLHAVAAYFRDNADEMAAIITKEMGKRTEEALGEVELCAEIADMYADRAPALLKPQPIDSTAGAAVTNHVATGIVFGVEPWNFPYYQLMRVFAPNFMVGNAVIIKPASNVPASGLEFEKAVLAGGADKGAFQIALIGHDDTETFIKDPRVAGVCLTGSEGAGSHVAALAGKYLKKSLMELGGMDAFLVLDGADLSSVIPEAVKTRLMNCGQVCTSSKRFIVLDKYYDDFVAGLKKGFESVKIGDPSDPSVDVGPLNSQKAKDKLQGQVDTAIEHGAKVVYGNTPVDLPGAFFQPTILTDIDKDNPAYHTELFGPVACVYKVHSEKEAIELANDVPYGLGGAVFAGDTNHAAEVAAQIETGMVGANQSQSYNAELPFGGVKNSGYGRELGDLGLFTFVNEQTVTRALRK

SEQ ID NO: 7995 - protein, 229 aa, Lactobacillus casei
MAKKGKKYLEAAKAVDSNKQYTPEEAVNLLKKIDYAKFDETVEVAYRLNVDPKQADQQIRGAVVLPNGTGKTSKVIVFAQGDQAKAAEDAGADVVGAEDLVQKIQDGWLDFDVAVATPPMMAQVGRLGRVLGPKGLMPNPKTGTVTMDTAKAVNDIKAGQVAYRVDKAGIIHAPIGKKSFDADKLLENFKAMNDIVLKARPASTKGIYIKSLTLTSTMAPGIKVNPTDF

SEQ ID NO: 7996 - protein, 141 aa, Lactobacillus casei
VAKKVANIVKLQIPAGKATPAPPVGPALGQAGINIMGFTKDFNARTADQAGMIIPVVITVYEDRSFDFVTKTPPAAILLKKAAGVEHGSGEPNTKKVAKVTKAQVKEIAETKMQDLNAADVEAAMRMVEGTARSMGFEVED

SEQ ID NO: 7997 - protein, 856 aa, Lactobacillus casei
MQYSQQQPQEVLATLRTREAGLKPAEAADRLEETGSNTVVTQHPRPWYLILFAAFNEPFVWVLLLLCIVSIMTADYDGARMMGLMITLSVSIHFWQEYRSQKESHALAALIANTTAVTRDGQTQERPMDEVVPGDIVQLATGDMIPADAYLIATHDLFVNQSSFTGEAMPVEKTAGKTTLEADQSLFDALNLVFMGTDVISGSGTAVILKTGDATYFGDMANQIGHKPAPTSFEQGMRAISRVLISMMLVLVPVVFVINGITKQDWSQAFFFAIAVAVGLTPEMLPMIVNSNLAKGALAMSKRKVIVKRLHAIQNLGAIDTLFTDKTGTITEDRVVVMRYVDATGATDPAVLRMAYMNANYQTGWHNLMDTAVVNYAHEHEAILADLPAGLTKIDEIPFDFERRRLTVVVANEDHQWMITKGAFEEMLAVCDRVELHGEVLPITPERLKQLQHTNAAMSGQGMRMIVVAYRQDVHQQEIYTTADEQHMVIAGFLGFLDPAKPDAKEAVGLLRNHGVRVKVLTGDNAIITQHVAEEVGIANQLVVTGNDVEAMDDKALQQAVESTDLFVKLSPLQKARIIKTMRAAGHTVGYMGDGINDTAALREADVSISVDTAADITKDASGIILLEKSLLVLEDGILEGRRVYANAMKYIKMTIASNFGNAFSVLVASIFLPFLPMLAIQLLVQNLIYDTSQMTIPWDNVDDATLAEPTPWRAKGLLRYTLTFGPLSSLFDITTFLFLWFGLGIGAHAASLPAQHVFQAGWFVVGLFTQSLVVHVLRTRVTPFWRSPASAIVILSTMLALLVGLFLILSPLHRAFDFAVLPLSYWPGAALIVLTYLIVVECVKRMYLKHGWPWL

SEQ ID NO: 7998 - protein, 491 aa, Lactobacillus casei
MISSALAQAAAIRAGAITSADLIDAAADKIAKLNPKLNAITWTRFAAAKHDAAQLKDNGQPFLGVPLVLKGLGQNFAGAPATAGSRLFKDAKATSTNNFVKALQALGFVIIGQSNVPEFGFKNITDATLYGPARNPWNLDYSPGGSSGGAAALVAAGISLLAAGSDGGGSIRIPASFSGLIGLKPTRGRLPTGPGEWRGWQGASINFALTRTIADTEALLRGLATTQLAAPFNAPPLHLENVNDPRPLKIAYTTQSPVGTPVSATAVKAVALAVDALRAAGHTVVEAQPDVDGTALMKAYYLMNGGETAAMFQAYTEQSGRAVTAEDVEPVTWAIYQAGLHTTAADYSRSLGVWDQAAEAYSHFHDSYDLLLTPTTAKTAPRIDAELQSPAIVDKMKHAAELAPDEQKQLVWDLFEPSLAYSPFTQQANLTGAPAISLPTAISPDGLPLGIQFVAAKGREDQLLRLGYWFEQHNLLQMYPLSESEDISPAE

SEQ ID NO: 7999 - protein, 178 aa, Lactobacillus casei
LKLYTKVGDHGATKQINGKKVPKYDPQIIALGDLDELDSWLGYVASQATATPGFDWLAQALEDRQRELYELLADVAVPRHQTITEAHVKALEDAIDDMMAQVPRITAFVLPGGHPLAAALQYGRAVARRAERSLDLLAEGDKTVTAVVLQYSNRLSDYLFALARYVNFKAGVPEVKSK

SEQ ID NO: 8000 - protein, 179 aa, Lactobacillus casei
MKLPTSAKKPSPVRAVALLGLLTALCTVLRIVKVPIPNVQPVTDILMVVTLLLGLRWGLGLTVSTLVVSNLVLGFGLWTLPQIVAYMICMLVLQAIVLMLPVVRRQLWLQIGLAGLLGYLYGVVVSLGMAVIGSLNGLGFWAYYISGLLFDTYHAIGNLVFYPIVLVVLQQGLKRFNRG

SEQ ID NO: 8001 - protein, 130 aa, Lactobacillus casei
MLKKALRSLVVFFAAMFVLAGCSNSSNSAAKSSSKPNQIVVTYQLKQNGKAFAKKKITQPKKSVVMTGLKKGWSVKASKGFITEIAGKKQNVAKKTYWLYTINGKMAKKGATTQPVKNHDKVVFDLSVTK

SEQ ID NO: 8002 - protein, 748 aa, Lactobacillus casei
MQVMMKPITLAPDFVAEVKKEIKPHWGELGWVTYKRTYARWLPDQQRTENWDETVKRVVEGNINLDPRLHTANPDSEVVDELQKEARNLFKLIYGLAGTPSGRNLWISGTDYQKRNGDALNNCWFIAIRPQPYGESHIVPTDFSADQPAVSMPYSFMFDELMKGGGVGFSVTKDNIAKLPPVANAVDLTIVIDRNSASYAESLKMGAVDREAWEQAHAAEHNDRYVLPDTREGWVLANAKVIDHHFATTNPGGQTKLVLDISRIRPKGARIHGFGGTASGPMPLVEMLLDINKVLNARVGQRLTAVDATDIGNLIGKTVVAGNVRRSAEMSLGSADDDAFITMKQDQKKLYHHRWASNNSVAIDTQFDAYAPIATAIAKNGEPGVVNLDLSRRFGRIVDGENAANDPDVEGTNPCGEISLANGEPCNLFELFPVVAVQQGWKLKQAFALATRYAKRVTFSNYDWQVSRDIIRKNRRIGISMSGIQDWFLDDFGHRVVSGFEPVVDPHTGKMLEKPIYNPEIKQAVDGLYHAVVDADQAYSDALGCEPSRKHTTVKPSGTVAKLAGVSEGMHFHYAGYLIQRIRFQANDPLLPALKACGYHIEPDVYTKNTMVVEFPIRAAHADDPAFASAGTVSIAEQIATQAFLQTYWSDNAVSCTVTFQPEEADQIAGLLSQYRHVIKSTSMLPYVGSGFKQAPKEPIDADTYTQKCAKIHGSVAAVFAAQNANHDQKDLELVDQTDCVGGACPIK

SEQ ID NO: 8003 - protein, 147 aa, Lactobacillus casei
MAEVYLAAPFFDPAQIERLDQVLAALHANESVTAIFSPRDDTNKAGLTPNSPGWQRQVFGEDIQGLHRSTVLVAILDYVGENPDPGTAFEIGYAYAHHMPIVALQLGEMKMNLMLAGSITCFVNDLVELKSLDLDHVLVRPYVGPVF

SEQ ID NO: 8004 - protein, 281 aa, Lactobacillus casei
MSGWFWILVTLGVIVVVGVMTDYFLLARTGYAPVPLVMDPTPTLFIPGHLGTRYSFGHMLWRMQRRYGLSKDVVAIVAPDSSVHLRGQLNLNHHAAVQVLYTDKTVRPAAQLRGLKHVIAALQAQQAFTRVNLVAHSMGGVTAALYLLSQPAVPVANLVTIAAPMNDVEVARRSPILNWPLTRQGPEHTAPIYQYFQRSIANLPADLRWLNIAGDLMLGGRHDGEVAISSSFAVRYLVKDRIKDYTEVVIRGPRAAHSLLHENRLVDHDIAEYLWQRQRDF

SEQ ID NO: 8005 - protein, 184 aa, Lactobacillus casei
MAETVTSAEKHWYVLHTYSGYENKVKTNLEQRTTSMNMDDYIFRVVVPEEEEHEQKNGKDKVEMKKTFPGYVLVEMVMTDQSWFVVRNTPGVTGFVGSHGAGSKPAPLLPEEVASVLHSMGMSTRHQNVEFDVGEPVTIIDGAFTGMHGKVTAVDKDKMKLKVVTEMFDREVTAELDFDQVDKL

SEQ ID NO: 8006 - protein, 56 aa, Lactobacillus casei
MKFIKSVFAEMKAVTWPTAKQTRRDTFTVIMTSIIFAIYFAAVDWVINMIFQAFLY

SEQ ID NO: 8007 - protein, 319 aa, Lactobacillus casei
MTQPYKHLTWPLFLEFIRLPAKAASMLPYALGISYAAWAFQQFSWVNSLLYGLAQLAIALFVTGFNNVQDYFKATDHSYQQQQNIIGREHLSPWGMLALTILMLLVSVVLGLLLVMRTNLSLLVIGAVGVGIAILYTFGPIPLSRLPLGELLAGIVEGFGTFTIAVLINMQAPQPLDLVLGRRTFAFSLNLGWLLQLFIAVLPIVILNAAVMFADNIADLEQDVKNERYTLPYYLGKKRALSWYRLIPFTTFVTLLLGIVTGILPIWSLLVLATWPLVLHNTRTYTASPSKDKTFIFTIRSLLSFGGALLVTLWLGILF

SEQ ID NO: 8008 - protein, 312 aa, Lactobacillus casei
MTLPIFLELVEIRTKLASILPFAIGTLFAVSYFHGFNAVNTGLFLVAMLLFDMMTTALNNLMDYRKAKDEHYQQAVNVIGREKLNPKLVSRIIIGMLAGASLLGIILVVRTDWLVLLMGMACFAIGILYTWGPLPLSRLPLGEIFSGVVMGLGIPVIATYINIVPGKLIALDWGWPTIVLHGDFIAIIALGLTCITPMATIANVMLANNMADLKEDERNHRHTLPMYLGHWWAPRVYALLAYVGFLAVLLAVVFGALPSWALLIELAWPLVIRNVHRFIRDPSKPRTFHTAVVNLVLENGLLTLGLGMGVLL

SEQ ID NO: 8009 - protein, 357 aa, Lactobacillus casei
MKKRVVVVLLMLLALVATACSGKPAAKRTLVEGDPYSDTQFLMGTVVTVKIYDKGKQGALDAAFSRVQQLADQLTVNQKGSEVDKVNQNAGIKPVHVTPSVYRVIAAAKHYSENSNGSFDLAIGPITSLWHIGFADARKPAQSEIDAKLPLVHYQDVVLNKKQQTVYLKKKGMAIDLGGIAKGFITDEVVKTLKKQHVTTAIIDLGGNIFVMGKSPKDAKKDWNVGIQDPKKPRGTAIGTLPASNKTVVTSGIYERYLKVNGKVYMHLMNPKTGYPFDNELMGVSIVTNKSVDGDALSTATFDKGLVDGMAYIEKLKYADAIFVTKDKKVYVSSGLKDSFKLFKNSGYTLATIKSRA

SEQ ID NO: 8010 - protein, 303 aa, Lactobacillus casei
MKLSKVVTGTAVVALSTLVLSACSSSSSSKNSSSSKASSSKVVKKSSTQKQVAGGPLKDGTYKLNETGYDHGYKVEMAMTVKDGKITSTKYDYVDKNGKSKTKDAAYEKSMKSKVKVGPKEYIPELNKSFQKNGTNVGAIDVISGATDSSLTFKNYAQQLIQAAQAGDTKPIEVNNTGKMKDGTYTLEEKNYFNGYRVTFSITVKDGKITQSNYDNVNKDGKSKTLDTKYEANMKKVNKVGPKEYIPELNKSLVAKQSPAKVDVVSGATHSSDTFILYADQLVNAAQNGNTNKIEVDNIVYNN

SEQ ID NO: 8011 - protein, 661 aa, Lactobacillus casei
NADHDEHYDRGENASELIKEPRTEINYLDMAKTNIVVVGAGFAGVYATKHLAKHYKRNKDVTITLIDRHSYFTYVTELHEIAADRVPEDAIQYDLQRLFNRRKNVKIVTDNVTGIDRDRKEVVTENGRFPYDYVILGIGSQPNDFGTPGVAEHGFTLGKWEDAIRLKRHIEDVVRRGSEEHDPAKRKALLSIVIVGSGFTGTETIGELRDWRDTLAKQYKLDPNEIQFSLMEMAPTIMNMLDRSDANKAERYMEKRGIKVMKNTGVVGVHEDYVDLKDGSTFPTCTLVWTAGVKATDQAKDFGLKQGRAGRILVKNNMESQDDPSIYVVGDVSLVDQDGTGRGQPQIVQGAEATAHTALSNIEAKLENKEQIEYKANYSGFMVSLGSKYGVANIMGWLHLSGFFAMLMKHLVNMLYFIQIYSGYYLFQYFMHEFFRTRNERNMFRGHLSRQGNVLWTVPARLTLGAMWLIDCWPKIQGKESWFIDKLRLPFSWLQPAATSGASAAGADATSAASGAAAGAAKATKTVFSLSYQYGNDPMMVFDKMPNWYYSITKTLIPNQQVAFFMQKAMTIMEILIGLALITGLFTWLTSAATIAFVGVFCLSGMFYWVNIWMIPMAFACMNGSGRAFGLDKWVVPYLQKVFGKWRYGTPQSLYGTDALK

SEQ ID NO: 8012 - protein, 148 aa, Lactobacillus casei
MKRPNTFKRYLKMIRPFDWIIVGGLFLTAFIPYLIFGIQENQQQQEASQRVLTAVVTHDGHEVYRKRLTGHTGTTQFTYRAKDGDWNKIEVQGAGVAITEANCQDQVCVRRGRITKPGQTIVCLPHKLLIEIKSNKGGSNNTGGMVTE

SEQ ID NO: 8013 - protein, 188 aa, Lactobacillus casei
MSIYKADRTRQYIYIALLCAQGVIIGLLERMIPFPFAFAPGAKLGLANLITIISLFTMSISDSFVLLWLRLLLTTLLGGTLSTFLYSGAGALLSWLGMLLIKQLGEKRVSMIGISAAGGILHNVGQLLVASLIAQSWTVMLYLPILAFMGILAGIAVGIAANFLFEHIDILRRLRYDRSKRRKKGATS

SEQ ID NO: 8014 - protein, 325 aa, Lactobacillus casei
MKIHPMWHEYPTLAPELSSALTLIEKQITTNNTPVAEAILEMINGGGKLLRPAYCLLFSRFQDTDREKMIALAAAIETLHTATLIHDDIIDKSPTRRNQITIQKQFGPETAVYAGDYLFVVCFKLLAHYASSLRSIQQDSGSMEKILKGELDQMATRYQTDITIDDYLKQVSGKTGQLFALSCFVGAYESGGSNNFAKAAEKIGMDIGIAFQLLDDILDYTSSGDTLGKPVCEDVRSGVYSAPLILAMQRDRQAFLPLLAKKDQISDAEMDTLRDLVIQYEGVKQAYAMARQHTDQAIAGLKKLPAGPAQDDLIRLTGSLLNRKA

SEQ ID NO: 8015 - protein, 67 aa, Lactobacillus casei
MNLPLTVRIALFTLIMVIVFIILGVIDAAWLKYRRRPEMIKQRRIGLISLGIVCVISGIGQILGLWP

SEQ ID NO: 8016 - protein, 40 aa, Lactobacillus casei
MKNKRSTNKTAVYISLFLGGIVVGLITSPIIQDLLRVIFK

SEQ ID NO: 8017 - protein, 259 aa, Lactobacillus casei
  misc_feature (5)..(5): Xaa can be any naturally occurring amino acid
NADPXIDREDCTASECENZYMEFDEPENDENTMVIQRVGILGAGKVGIVLAGLALDAGYTVRISGSGSVKKIALTIKTLVPGAIASENADVVANSDIILLAIPLSRYKNIDADLLKGKLVIDAMNYWWETDGIREEVLDPDTTSSEQVQAYFKDAKIVKTFNHMGYHNLQEEARPKGDPRRKALFVTGNDPDAVATVAAFVDTMGFDTVVHNNLADGIMTEPGSPLFGASLRYAEVKDIIDHFDQTEFGKRIAAKVHSH

SEQ ID NO: 8018 - protein, 351 aa, Lactobacillus casei
MVDIEHLQFGLETFGDIVANEDGSLQTAAASIRQIVREGELADDLGIQVFGVGEHHRPDYSVSSPETVLAAISAVTKQIKLATAVTVLSSDDPVRVYERFATLDALSNGRAQVMLGRGSFTESFPLFGYDLTDYDDLFNEKLGLYDALRNEKAVTWSGKFRAALKNQEVYPKTENGKLETYIGIGGSPESVIRAVKFGYKVIIAIIGGQASRFKPYIELYHAAAKELGKPEFPIAVHSHGFIADDENEAVEVAFKNIKANFDRIGLTRGWAPMSREQFDGETKVGSFYVGNPETVARRMAETIDLLDLGRFDLVYGAGNQTAAQRERMIELYGTKVIPRVKEILAEKAAVK

SEQ ID NO: 8019 - protein, 200 aa, Lactobacillus casei
MGNQVRVKNVSFSYDDNVLFRDLSLHFSSGSIYRIMGSNGVGKTTLLKLLAFDLLPNEGVIDTDLMREEIVYLHDGNILDPNLSAKEHVDFLISFDKINRQRLAKLPYLLEKMKLEAYYNELTSALSLGTVMKLTFLLFWLQEPKMLMLDEFFSGIDTSGMRYIVDLINEMATEGTIILFVTHVDQNADLLDYHPVKICE

SEQ ID NO: 8020 - protein, 500 aa, Lactobacillus casei
MIEVLAVSLKRGLSGVPFVDTLSARKTVWFWGMINLAGLAASIIILREILISGVLLDDIKKIMMVWSGFTLNVPEVLGIIVAVNALIYYQDLKSLCLMSLNQPIIRFGVRSGISSSLLKAAFCIRAIISITRIPFLLFLITLTIENLRGVRWLSCSLFLATLGIALITFMHFSLEKWLRNELIKNGLVLIFAFVFTASVGKSLCVEFIRIFLNEKILTVASFFSFEPEYVLFLVLILIVFFGLYKYRKPISLRWSYMKDPVKNAISLAIKDTGQIGTWFYFISGSGLALLMSSLDERYSLLVVFITIYYSTMVLYQTIINNLPGYFEINVHKQIFIWNNHLEVLVRRCLCSFLVYLTVKLMPLVFLILLFSWIKGLSFLEVGLQILGTLSISYLMAVVYQLTGLLGYTRNHDTNAFEIREQLRVKSFRTIIEGISLAFVAPCSALPLTLLVVDRINIQLFIILETAMTLTATLSVLVLLTVVSLCIKRGRYGQSGSGKER

SEQ ID NO: 8021 - protein, 93 aa, Lactobacillus casei
VSHMVLRHRKAAIVLAVAAFAIVLVVAVRYNAIVADIAAAVPLSRETRKTIEMFLDAGMGAAAIITLLGGGGLIAYIVRQAFKSGGKKLILAA

SEQ ID NO: 8022 - protein, 52 aa, Lactobacillus casei
MTNLKDSELCQITGGFLPFAIPVATILGILATDAFNHADQLIDGFKQGWERP

SEQ ID NO: 8023 - protein, 65 aa, Lactobacillus casei
MQQFVTLDDSRLERISGGGTDNFWTYIGMGLGAIARSWVQGGFVAPAMSLSIDVLNELKRKENLP

SEQ ID NO: 8024 - protein, 294 aa, Lactobacillus casei
MNPYANLSPHKIANRINEAADALGVPRQNMQLLFRLQELLRQISESAYQDNFIFKGGFEVAMIVGVSRRTTIDLDTTMNNQDLNPDNLKKVLTTIFDHAQSPIHFTVTRIKSEMNEHEYPGFRVGVLGTMGKTRSKLNIDVSTGDVVYPKPMRLTHTNFIDSTDKFMMNAFSLEQIMADKLVTIYQKSIRNTRAKDFYDIWVLGMTILADLDQSTLVEAFKKTAKAKGISDISLKQGKEIIDQLKTRPDMVRSWQGYQETKKFARGIELNQALDNASEQLKNIFNDNTFNSIHT

SEQ ID NO: 8025 - protein, 198 aa, Lactobacillus casei
MGKNKGLDSLLADYHTFVSGTAAQYGVSSSMLTNAIREGRISREARGVYVENGYTWDDFAILSQRYSRGVFALDTALFLYGLTDQIPDRFIMAFPRGYRNPRLSEHWIVPIYYVPNRYFPGITTVETPNMNFVRTYSVERTLLDVWERPDVAPYTRNEAFKNYFDEYGQNNASFERLLKLKKQLYPHSDLTKLLEVLV

SEQ ID NO: 8026 - protein, 179 aa, Lactobacillus casei
MREHILIVDGYNVIGNWPELAKLKAEDHFDVARDRLLDILAEYRSHENAKIIVVFDAMYVPGIGKSYAKWDLQVVFTKEDETADSYIERLAQEMNSPLVQLVVVTSDQAEQWTVFSRGALRISSRDFLKEVQRSDREFNHDTANYAAHLARRNSPWNNDQLFLLDKMRRHLERRPKPKE

SEQ ID NO: 8027 - protein, 260 aa, Lactobacillus casei
MAKEPQAAPNEHDPDEFVFGRHAVEAALKAGTAATINKLFIQTDLKSEPIQHLIGIAQKKKILVATAPKQKLDLMSDHSNHQGVLLAMTPYAYASVDDLFQHAADKGEDPFFLLLDNLEDPHNLGSILRTADASGVHGIIIPKHRAVGLTSAVAKVSTGAIEYVPVARVTNLAQTIKQLKDRGMWVFGTAMDGQDYRQWDAKGSTALVIGNEGKGISPGIAKLMDATIAIPMVGHVQSLNASVAAGILMYQAFASRHEGK

SEQ ID NO: 8028 - protein, 143 aa, Lactobacillus casei
MTFDPKQLNGIALAYMGDAVYEVYVREHLLKRGLVRPAALQRAAKDFVSAKAQAALIAGMEDEHLLNDEEVAVFKHGRNAKSYTHAKNTDVVTYRVSTGFEALFGYLHLEKHDKRVAELAAWCIQYVEEGKTGHGKRAASSTK

SEQ ID NO: 8029 - protein, 468 aa, Lactobacillus casei
MLTLYNTMSRQKEPFTPLHPGEIRMYVCGPTVYNYIHIGNARSAIAFDTIRRYFEYRGYHVTYVSNFTDVDDKIINAAHKTGEAPLDLAQRFIDAFMEDTTALGIEPATAHPRASQMIPDIIDFVQDLVAKGYAYAVDGDVYYRARKFKHYGELSHQNVDELEEGASQHITQEELAKKEDPIDFALWKAAKPGEISWDSPWGKGRPGWHIECSVMSTQLLGDTFDIHGGGQDLEFPHHENEIAQSEAKTGKQFVRYWMHNGFVTIGEDDEKMSKSLGNFITVHDILKTVDPQVLRFFMAGTQYRMPIRYSDANLKNAANSLNRLKIARENLVYRRGNAVPGVDPKITEQLQTLKDQFITAMDDDVNVQNGLTVLFDLAKLLNEYANEDTVKRESLDDLLNLYDAWLQIFGVVFADQTNLDADIDALVKARDVARAAKDFAKSDQIRDQLAAQGIILEDTPQGTRWRRK

SEQ ID NO: 8030 - protein, 464 aa, Lactobacillus casei
MAIFTAYDNAEILAALRAAAPHAEIHTDDQVAREYSANGNAQLEIDGRILAYVAAGDVADIQGVLKIARQYHIPVVPQGADTSTVIGADGLNGSIILSTVRMNRIKEISKGDLLAVVEPGVINGDLDKEARKQGLFYAPDPGSKPISSIGGNAATNAGGMSTVKYGATTDNVLGLKVVLADGREIKLGGRTYKHAFSYDLTHLFVGSEGTLGIITEITVKLNPIPIGTPVVGVAYFDNMTALAKGVEDLRLSGIYPVTLEALDGLTVAALDRYEGTHYAEGAEAMLIFRLDAGGEASLKMAEQILTADHAKNIKVTSDPDEAGAIIKLRQDMLPAVFANGQHIMEDMAVPLSKLPEMMDYIAEVAKDLNVEIYTAGHAGDGNVHPTVIWPADQTEPPKEALQAIRMMFRKALALGGTISGEHAVGMSKNQWNNEELGFDVDEIQHQIKDLFDPLNILNPKRKID

SEQ ID NO: 8031 - protein, 497 aa, Lactobacillus casei
LADRPIRVRYAPSPTGHLHIGNARTALFNYLFARHNKGTLVLRIEDTDTKRNVADGEKSQMENLHWLGIDWDEGPDKGGDFGPYRQSERKDIYDKLIKQLVDKGFAYESYRTEEELKADREAQKARHEMPHYEYEYEGMSEAEKAEAIAAAKAKGLQPVIRFHIPTDKTYEWDDIVKGKISIDANTLGGDFVIQKRDGMPTYNFAVVVDDHLMEISHVLRGDDHIANTPKQLAIYDAFGWEPPIFGHMTLIINGATGKKLSKRDETVLQFIEQYRELGYLPEAMFNFITLLGWSPVGEDEIFTKKEFIKQFDPKRLSKSPARFDQKKLEWVNNQYIKAKQKTNPNELMSMSLANLIEDGLIHSDPDPKTIEWARQLISLYTDQMSYTAQISKLADIFFDKATDLTDDERKELADDNAKPVIEAFAKKIRALDTFDAYSVGRIVNEVKQETQVKGRKLYMPIRIAATLRMHGPQLAETIELMGRDQVLKNVDLVTSQL

SEQ ID NO: 8032 - protein, 275 aa, Lactobacillus casei
MSKIVNSTVSQAAIVMMVIEIIICLVLPIALAVWMIQRRSHPKKGATPVFFIGMAIFILFAGILEGPFRGIARQFQHTPWLYALYGALLAGVFEEVGRWFGFKWIQRRIPQKAKTPETPFLYGLGHGGLEMMLGGGLSMLSNVLFATTINSGALAKLMTKTPASARAGIITAVKQLTGMSGWTVSLSLLERLLALTIQIALSLVVWLIVVNRKRWFWMLVPVGLHAFIDFPAGLSQAGALSLTVTELLLVVQTVIVLAFVYWLWRREKPNSTVSA

SEQ ID NO: 8033 - protein, 1166 aa, Lactobacillus casei
VRPIGEEKVHSKLYKDGKLWVVMLIGLISVGGAMPTHRVAAKSAATPSVLTQRSTALGKTYGLSTPGSTSSVTAQQQKQSQTVMAATADTNKNVTATSDDINEWMPDKDLQAIIVGELREDNNIDITSPSQITKQMMKELTWIAPTQDGTDLTMWHHVLNVKSLEGLQYATNLTWLDLSPDQNVNYAQTGSTLKNTQLSDISAIANLNKLTYVNLQMCNLHDISAFKNLTHINSLSLSYNHITDISALAKSGPGIYPMSPIGGQSYVMPTLHLNPATDSLTLSAKGIYNLDNDKLPVTPFDSQTEGDYDRIPQNDQNFASRYLSNATGSVLDENGNVIKKAGSTIKWTNLQNNGYLTYFWTDKFKGGNGYPFDGFVIIPYEKDATVGNVTVNYVDENGKNLGTTLLSGKLGTDYDVLSDQNVTQELTDLKTRYGYTSDQIISGSQKGQYSAKGATVTIQLSNTKQVTETKTVKQTINYVDENGKALHDSATNALTFKRTNTVDANGKVVAYGQWTPASGSFKAVASPKIDGYTPDKANSDAINDVTADSPDNVQTITYKKNPIATGSVVVNYVDENGKTLAPSVTLNGNVGAAYTTEQKKIDGYSFEKMGPDSAAATGKFVDGRLTVTYVYKKNSLPVTGITVTSRYVDENGQQIASDKTINGKVGDPYQVAPIDIPGYQYAHLAANSAPATGQFIDGDLTVTFVYTKTPAAQGTVNVKYVDDSGNQIAPDKTLSGKVGDPYNVSPISIDNYQYAHLANGSAPVSGQFTDGSLTVTFVYTKTPAAQGTVNVKYVDDSGNQIAPDKTLSGKVGDSYNVAPINIANYQYAHLANGSAPVSGQFTDGALTVTFIYTKTPAAQGTVNVKFVDDQGNQLAPDQTFSGKVGDPYTISPISIKDYQYAHLATNSAPASGTYTNGTVTVTMVYTKTPVPQGSVNVKYVDDAGNTLAPDKVLTGQPGDPYEARPIDIANYQFTSLAPGSAPENGTFSTGTLTVTFVYSKTPAAQGTVNVHYVDENGNALAPDKVLTGNAGTPYTTTPTTIAGYQYLRMAPNSVADSGTFTNGTLNVTFVYAKTSTPVTPSTPVTPSTPTKPSMPNPPSNVLPSTGGSNGATTTIITPTNKAKHTLPRTHEEEQIGLTALGVVLLALAGFIGIRWRRRTKKVSHKN

SEQ ID NO: 8034 - protein, 258 aa, Lactobacillus casei
LFTLLKQETYKLLKRPSFTIFWLFLIVFQLAMAIFGKVYPQTFQPENLFLNDFYAPVMIVFYIIAVGSTQLSSENQYGTLKALLYRQYSSSKVLVSKWLTLLGCALCFYGSSLVMTFLLKVIFFQNKFSLTLQVSTHQPIWQAMLMNTVSEFLTLLFLAAFVLLLATLFDNSTPAIIVGISAYFVVSVFNQLMFMLIDQHDWLKWNPVNMLNFGAQLNSPKLSSLTHLGINQMMIGYLAYGSIFLILGLIVFRRRNLR

SEQ ID NO: 8035 - protein, 292 aa, Lactobacillus casei
MLTVNNLDKWFGKKQALHQISFEIKPGRVVGLIGANGAGKTTIMKTILGISNFTGDIRLNDQKITVNSHDALKDVGALIEYPGLYPYLTGREQLHLFTRGADRQAKVDKVIEEMHLTSYADSKAKHYSLGMKQKLGIALALVNQPSLVILDEPMNGLDPKATRELRELILQKKAEGTSFLISSHILSELQKVADDVVIINHGHLVTSNTMNVVLARNESYLLLQTDQNDRAAQLLLQKGYQAAVEEGSIKIARNSIQNMTSLLRAVLDQNIAIHDIHEQQDDLENSLLGIIE

SEQ ID NO: 8036 - protein, 298 aa, Lactobacillus casei
MGVRDAGYMFKKIRLERGLRISDMAGSLSASTVSKFENGHTDISVEKLCLLLDNVGMDTTEFFEILNQNHDTNASPADLSQRAMDKRMLRYAMEQDVDGLKQFRQSFSSKFKKTHARLYKLREIMVSAIILDTQDVHALLSKTDSKTINDYLMGRDTWYALEYALYGDCVPFLQPDDFNRLYAKFLAIHFDFHQRHNYLDLFFSAFYNVGVSLYYRCEYAKAIQTLNRLQEQSVPDNLFFLRIQLRLLKLLCTYKLTGNSNAANELNAMVKVISKISPAFGRRWKVDFSFQEPITDEH

SEQ ID NO: 8037 - protein, 402 aa, Lactobacillus casei
TRAMDMAINCNTAININGPRTEINPRECRSRMKKRIVYLIFGLIGIGVGMGALPALWEAIGWQHHLIVNNLLTNGLIGAIIFLLLASLSVNWILGRLKVLEKTLNTKSPSYLLFGSLSTTIGLILAAIISIPLYRFIAPLNIFLPLIIMLLFGYLGFRVGTTRSEEWRRLLNFRNRRTADTDNDQVLERKVGDHFRKYKLLDTSVIIDGRVQAIAKTGFIEGTMLVPNFVLHELQLISDSADSMKRMRGRRGLDILNAMQKDKDIHIEMYEGDFDDLTEVDSKLLKLAKLLDGIVMTNDFNLNKVAQFQNVPVLNINALANALKPDVIPGENMTVTVIKSGSERQQGVAYLDDGTMVVVEDGKFYMNKPLEVIVTSALQTAAGRMIFAKPAHQQKAIRDKEK

SEQ ID NO: 8038 - protein, 454 aa, Lactobacillus casei
MAKAKTQYVCQNCGYISATYLGRCPNCGGWNTLVEETVSSTKSAPRQTRAGSKVKPMRMDEVTVAKETRVKTGLAELNRVLGGGVVSGSLVLIGGDPGIGKSTLLLQVSGQLASTGGTVLYVSGEESASQIKMRAGRLGVANSGMYLYPETDMPSIEGVIDQMQPDYVVIDSVQTMNVPDMNSAVGSVAQIREVTAELMRIAKSKGVTIFIVGHVTKEGAIAGPKILEHMVDTVLYFEGDMHHTYRILRSVKNRFGSTNEIGIFEMHQNGLQEVANPSEIFLEERLAGANGSAVVVSMEGTRPILVEIQALISPTMYGNAKRTSSGLDHNRVSLIMAVLEKRANLMLQNQDAYLKATGGVKLDEPAIDLAMAVAIASSYRDKEIPPTDCFVGEIGLTGEVRRVNRIEDRVKEAAKLGFKRIFVPRNNLQGWHAPKDIQVIGVTSIAEALHKVFN

SEQ ID NO: 8039 - protein, 179 aa, Lactobacillus casei
MKTRGFEIVSKYQDDDLTLPTRQTKQAAGYDFYAREDFLLKSIWRYDFIRLFRLIKNERPLTNKDFERAEQILKPYLVPTGIKAYMQPNEVLILANRSSNPLKHGLTLPNGIGVIDADYYNNPDNEGEIYIQLLNFFPRDVMIKKGDRIGQGIFMPFLLADGDQGGLAKRQSGFGSTDH

SEQ ID NO: 8040 - protein, 112 aa, Lactobacillus casei
GNATFAMILYPRTEINMEFQHEPGRIFNTDWDGRLLAELTYQSIDDGQAWAVDHTFVDESLRGQGIAGQLIEAVVAAARQEGKTIEPLCSYAVHAFHNHPEYADVLRPVKDN

SEQ ID NO: 8041 - protein, 439 aa, Lactobacillus casei
MSEITFDQIKAFQEQLAHHPAAAARSRAVQNVGPQAASREAIDGEDMKPVFSLDLDTGSVANQKKSGRCWLFATLNTVRHGIADEFGLKDFEFSQNYNAFFDRLEKANLFYENILATADKPLDDREVATYLSGPDQDGGHYDQAAALIEKYGLVPKSVMPETYNSNKTAELNSVLNEKLRKDAKVLRTLKQQHASEDAIAAKKRELLSVVYRILAYTFGNPPTTFDFEYRDDKKQYHRDTGLTPQTFFKKYVKWHFDDYIVVASDPEPSKKYQQLYAIKAANTVVEGHPLTILNLPPERLEQLALAQLQAGEVVWFGNDVLADMDRKSGTLKGGLFNYNDLFDVDFHVDKADRIVTTEAEMSHAMTFTGADVVDGKVTKWKVENSWGKDNGHDGYFVADASWFDQYVYEVVVRKSLLTEAEQAALQTTPINLPVWDFLN

SEQ ID NO: 8042 - protein, 448 aa, Lactobacillus casei
MSAEITSGDLDQFKQDLQATPGAAALQKAVMNNGINATAENTDSKVAMTPTFSIELETGAVANQKQSGRCWMFAALNTMRHGIQALFKIKDFELSQNYTNFWDKFEKSNYFYENVLKTADQPLDSRKVAFLLATPQQDGGQWDMLSALIEKYGIVPKSVMPETYNSSKSNELNGLLNLKLRKDAVELRKLVADKASDDDIEAAKQKMLAEDYRILAYALGNPPTKFDFEYRDDDKNYHIDRELTPQTFFKKYVGWNLDDYQSIINAPTADKPYNHLYTVEMLGNVVGGREVRHLNLDIDTFKALAIKQLKAGESVWFGSDVGQSSDRQLGILDTNIYKKDDLFNTDFTMTKAERLDYGESLMTHAMVLTGVDIVDGKPTKWKVENSWGDKVGEKGYFVASDDWFDQFVYQVVISKKYLPTELQDVIKNEYAKPTVLAPWDPMGALASR

SEQ ID NO: 8043 - protein, 74 aa, Lactobacillus casei
MIIKAKKVGNTMTLTVPKELKIAEGTEFTVEQRSDGSLVYLPTRHNPFESDRSRQDLRQAEVTLEQDILPSEWD

SEQ ID NO: 8044 - protein, 366 aa, Lactobacillus casei
MGTQLGFDWRQMVHSRKNLALAGLFVAAFIIGFFALMWTHRLDVGQTAQATANAAVANYAEYNLDTLSKSQKPLLANLDAQNSATGVIGLGIKLGEPDTTRNGLLSLRNAQLEMRQRHFKAINTMPLPPLHQLKGDVLTLTRLKNDDKPAVTGVTTSSSYIVTILPYLSWLTGAAAILLACDSWVERRRHQTLMTARPLTAGVAGSSRVLTLTGFYLLILAVGLLVIVALPAMFNGLGDTAYPLAVMGETLLPLWQYLLPFGGLTLLAGIWIITCCMLINTWVTNAYLTTFIVTAAALLPLMLPQVFRWLWFLPLPYLDSYATLSGTLVDRLNQPLASVGVGAALLLGWAIVNLGLFGYRVKKEDA

SEQ ID NO: 8045 - protein, 397 aa, Lactobacillus casei
MRYFRFQLHQLLTNRKNLAVIGIALVALLCQFVFFPPNNVPAELPTRNALTRDRDKNVAFVNEPHGPLTAKWVPATREFANIETRMLNAQKQQHTQSYVKATLHYLAFLGQNAANPDAQSSPFHYPLSYYFENRQYPDADAAFANATMYRSLEPLAKQAHPDTATVKQQTFWQTLFRGASGGWLTALLIVTILFANDLLTREQRHRSIARLLPISPWHAVNAKTFTVFTALSGFLMAAIAIIAAFVIPQHGLGSLSATIAYYAKDGMSIKLDPLVLGIALPTILGLTLLLMWLFIRLNLLCQSLFHNELVGLVVSAFLLFGEPLYFMHGIAFSVPQTAYYLPGYMNPAAIVSGLQNFRYDTSRMSPLAAVVVIGSVILILEVLLFIVTHRRRAAIIK

SEQ ID NO: 8046 - protein, 292 aa, Lactobacillus casei
MELQLQSLALSFKNKPHVIDNISLTMSSGSIVGIVAPNGTGKTTLLRLILNDLKPQSGKVVLDGQTYGSQKQSLAMHRQMCLFPVQDDLYPDLSGKAHLDYYARLWHNRKKSVKQIITALDMHDYVNQPVRTYSMGMKQRLCFGMVMAANTPIMLLDEFMNGLDTINVARMSRILRGLRAEGKLIITVSHLLNNLQGYADLIYFMRDGKIIKTIDQHQQQPLYIQVAADNANRLPRMPWQHYPNGLLVLPVNELPGQHFNQLLLGLAAHHIAFKLAPLDLDTYFNEFYEAER

SEQ ID NO: 8047 - protein, 684 aa, Lactobacillus casei
MASGLAANKKLQHKISAAALLVTLGVVYGDIGTSPLYVMKSIVAGNGGMGHFDTDFLVGSVSLIFWTLLIITTIKYVLIALRADNNGEGGIFALYTLVRQRARWLVLPAMIGGAALLADGMLTPAVTVTTAIEGLKGVHINGNILIDNQQQVIWVTIFIITFLFFIQRFGTDLIGKAFGPIMFVWFTFLGVAGFLALSKDWSMLRALNPYYALRLLVSPDNKMGLFILGSIFLATTGAEALYSDMGHVGRGNIYLSWPYVNICLVLNYFGQAVWLDRNSHVTAFNKISDFNPFFQMLPESIRLGAIILATLAAIIASQALISGSYTLVSEAIKLRFLPRLHIVYPTRLKGQLYIPVVNTILWVACLAIIAYFKTSAEMEGAYGLAITITMLMTTLLLYQYLRVHHAPTVIALGTLIFFGAIETVFFISSAVKFLHGGYVTAMIAFVILAIMFVWQYGGRIRDDNTYRAEMASLFAYKKQLSELRSDPNYPTYTTNLVYMTQIANDHYIKKEILYSILDKRPKRAQVYWFVTVNVTDEPYTAEYTTDTYGTDYMVNVQLFLGFRMEQQVNVFLRQIVNDMMREGELPTQPQKYTTIPDRQVGDWTFVLLHEELSPQTQIKGFQKTIIQARLWLQRVTVSPAQWFGLEYADTLDETVPLVLGKIPITKLTRLSRSQVDAQAEDEDD

SEQ ID NO: 8048 - protein, 876 aa, Lactobacillus casei
MKQIYVFAEGNMEMRALLGGKGANLAEMTNLGLPVPPGFTMTTAACHDYQQQHALSDTLLAELDEHLQALEQATGKRFDDPTAPLLVSVRSGAPISMPGMMDTILNIGLNDQTVQALATLTADTRFAYDSYRRLLAMFGNVVYGLSESAFDDVLTAIKQEKGYTSDLALTTDDLKRIIQAFKQLYTDAGKSFPQSPKAQILAAIVAVFESWNNRRAVIYRRENHIPEDLGTAVNVQTMVFGNAGEDSGTGVAFTRDPATGKRALFGEYLLNAQGEDVVSGVRTPQPVAVLHEQMPEVYDQLAAIATTLEQHYRDMQDLEFTIEHGELYLLQARNGKRTPAAAVKIAVDLVNEGLIDRQEALMRIEPKSLSDMLHPEFDPQALAAHDVLATGLPASPGAATGEVYFTAAEAKAAHEAGHQVILMRQDTSPEDIEGMIVSQAIVTARGGMTSHAAVVARGMGATGVVGMHALSVDEHAKTATVGDIVLHEGDWVSVDGTTGHLYRGRITTTAAMVKESLATLLDWAKAASRMGVYTNADTPKDLQQALAFGADGIGLTRTEHMFFQPERLLQMRRLILAKDAEGRKAPLAALEKMQEQDFYDLYRLATGKSVTIRLLDPPLHEFLPHDLREINEVANELGLEQNQLRERMAALKEVNPMLGHRGDRLAVTFPDIYAMQVRAMMHAVFRLADEGVTVTPHIMIPLTNSETELRWVRRLVSNEIEQMTSAKGIQVTYEVGTMIETPRACVTADAIANAADFFSFGTNDLTQLTFGYSRDDVGSFLPAYLEKKILPADPFQTVDTEGVGTLMKMAIDKGRATKSQLPIGVCGEVGGDPDSVAFFDSIGVSYVSCSPYRVPVARLAAAQATLRATTKAKARS

SEQ ID NO: 8049 - protein, 185 aa, Lactobacillus casei
MTGETLAAKLKISLATIRADLRLLTTIGILDARPKVGYAYQGASILPAGNEVLFKTAIAKILLPPTEIKLTTSMEEAVTKLFIADVGSLYVLDDDGALVGLISRKDLLRASFTGRDTTLPASIVMTRMPNVVTVTADTTIMDASKLLLKHNVDSLPVVQNRGDTHVIGKITKNRIFKYLIETLAP

SEQ ID NO: 8050 - protein, 223 aa, Lactobacillus casei
LVKLVLLRHGESIANQQNTYTGWSDVGLTAHGKAQAAEAGSKIATTGILFDHVHTSVLSRAIMTAYIVQDKIGQNYLPITKSWRLNERHYGALRGINKDLTRKLFGPDQVASWRRSFYAHPPLLAHPSRSRRYHQYPATIIPRGESLADASERLLPYWSAELAPRLMAGKNQLIVAHGSTLRALVKYMEDISDAGINKVEIGNAQPIVYTLDDHLKILKKQTL

SEQ ID NO: 8051 - protein, 368 aa, Lactobacillus casei
MAKSLRSVTMVELFYDLIFAYAVGRMAQTLALPVHGRIAPQIIGEFLLMLLVFWVIWTYQTVLTNQFSHPQWRHNLFSLFNMFWVIVLSTAITSDLATTKWPFQLSMAVLFLSLASEYGLTWRKSHATLAKISGLTLATGSVIALISLFLKPYTLSFAVFFVAIIGAALMPSLVWRPNRAPLTDLAHLSERYALLVLLIFGESIIGVADTVYAGLSFPAALFFLVVMLLFVAYQLVYDNGLNRRQKNGGLAVIHLHYPLMAAILSLSTLIHLWLAHLLDPQWFAFAITLTLAVYYFSLIGYLSAYPIKRIDIGFKRWFYLGFSLLIFGVYSLMTSVMPLPFLLGLTAYLLADTLYLWQFILHPNGPMY

SEQ ID NO: 8052 - protein, 393 aa, Lactobacillus casei
LIKTHKIKLYPNATMRRELERLFNYRRFCWNQALETWNTMYDASLVMADKTLRPNERKVRDELVWNKADWQYERSAQVLKLAVNDLSKAWKNYFNPKMPDHDKPNWKSKKQSRKTFKTDRAQLVNGKLRLDKPHGAGAWYDIKLAEQPRWQGELKQVCVVQDADGYYASFSIEVSTSVEKRPVLSVTGVDANIGKFDYQTPTGYATQSTLPERLPRIYARIAHYQRQLARKRKVNPKRFNSKAYRTTRTKLKRQYQRVERIQTDLLQEFTTKLITDYDLIGIEDLDNHHMRMNKRLAKNLHRSLFGKFKVIMQYKADWYGNTLVLADRFYPSTQRCSRCGYVKTADERVTLSGNLKHRTGHDDYHCYQCGVKLRRDENAVENLVAYAKSKVTG

SEQ ID NO: 8053 - protein, 94 aa, Lactobacillus casei
MTTYDVTFNTVDGKSLIKRNVESDHENARVWEDAVERFDADHLYIKMNDKTMVSLLRRAVVRIDMTELPSDIEKRANRRDEFRNAMYTLSQIGL

SEQ ID NO: 8054 - protein, 371 aa, Lactobacillus casei
MTVVNGYEQSDAEKKLNILNLPSLADEAKKIIPTGGFGYIVGGSEDEWTLAENTKAFNHAQIVPKALSNIDSPDLSTSFLGIDLKTPVMMAPTAAQGLAHSQGEKDTARGVAAVGGLMAQSTYSSTSIADTAAAGNGAPQLFQLYMSKDWDFNKSLLDEAKKAGVKGIILTVDATVDGYREEDIINNFQFPIPMPNLEKYSEGDGKGKGIGEIYASAAQKIGEDDVRRIAEYTDLPVIVKGIQSPEDALRAIGAGAAAVYVSNHGGRQLNGGPASFDVLPAIAKAVNKRVPIIFDSGIRRGSHAFKALAAGADLVAFGRPVIYGLALGGAQGVQSVFEQIDHELEIIMQLAGTKTIEDVKHAPLTHFNYAD

SEQ ID NO: 8055 - protein, 69 aa, Lactobacillus casei
MADFDAAKDKVSGKVKETAGKVTGDESTEAKGKTEQMVGEAKEKLSDAKDKIAEKFNDVVDKAKGKKED

SEQ ID NO: 8056 - protein, 85 aa, Lactobacillus casei
VSQDIVVGDKVSVRKTKDVPLSFKGTVEKLYANAAMLTIDSFSPDDASLVEDMKNKTVVNYKHIKKGGKAVIPPAPEEKRPGARH

SEQ ID NO: 8057 - protein, 68 aa, Lactobacillus casei
MLFAAHLRDYAVVGQYTDKWGHRHDSSRICHQMTKKEAREAMQRYLLQHYSDSVDLNAPIKVKVQATK

SEQ ID NO: 8058 - protein, 84 aa, Lactobacillus casei
MKHAKTGMTVLCQANGNMEHAFIGQIEKCYENAALVKILDYDRRDRFNVQDLIGRTVIAFNKMKQSKSDRLDTTYDKPLQRDVG

SEQ ID NO: 8059 - protein, 381 aa, Lactobacillus casei
MGTWIQRTTQTWLVYQMTKSAFLVGLLAAAQFVPIMALTLVAGTLIDRYPKRQILLLTQFGFLVLGAIMTTLTFLKIIQYWQILAIALGYGILQSFDTPTRQSYVIELVGRKDLMNGISLNSSIFNLAKIAGPSLAGILMVTIGVAPCFLIDTLSYIAIIIGLFMIHQEHPVARHTPRHILADVKEGLVYIVHHDNVKLSAELMLIICTLNFNNNVIIPIYAQEVLGRGAQGYANLLSATGIGSLIAAFLMSYLARFGLRRDLYLLVALGTALIQTLMIFIHVYWLAMIFMIVIGFCNMVFLNQSNAAFQFSIPNELRGRIMSVYVLLNQGSTPIGSLYVGGLMDVAGGLWGFPSCGLLALVLVIPTLLGHRTTVKHWLHA

SEQ ID NO: 8060 - protein, 418 aa, Lactobacillus casei
MDTTTIDLEQMGKVAKAAAAILGQLTTAQKNAGLLAMADALETHTETILAANQADLKAASKMTSKFKDRLVLTEARIADMAAGVRQVAVLDDPTAQTDRAWVNHAGLTIAQKRVPLGVVGMIYEARPNVTVDAAALTFKSGNAVILRGGKEALHSNMALATVLQDALAAHGLPRDAVQLVTDTRHEVANQLMHLNDYLDVLIPRGGRGLIKVVVEQATVPVIETGAGNCHIYVDAQAQLEMAVAIVVNAKVQRPSVCNAAEKLLIHADVADEQLPVIAKALQEHGVELRGDQRARAIVPSMHAATDEDWDTEYNDLIMAVKVVDSEEAAIAHINAHNTKHSEAIITDNYQNSQQFLQQVDAAVVYVNASTRFTDGFEFGFGAEIGISTQKLHARGPMGLAALTTIKYQVLGNGQVRED

SEQ ID NO: 8061 - protein, 279 aa, Lactobacillus casei
MVKRAMHCKRIVVKIGTSSLIHQNGKVNLQTIDRLAYALTALNNQGYELVLVTSGAIGVGMAKLGVSARPAAIAHQQALAAIGQSELMTLYTQRFSDYGAKIGQLLLTHDVFDYPQTRQHVLDTIDALLAQQVIPIINENDSVAVDELDHRTTFGDNDQLSALVAKQIDADLLMVLSDIDGLYDRDPNRHSGAALIPEITHLSAKILTGAGGSSTRFGTGGMVTKLKAAQTMMRAGKQMVLASGRDPRIILRIVAGEPVGTWFGNVLEQVSPDNQASNS

SEQ ID NO: 8062 - protein, 148 aa, Lactobacillus casei
VFEKQLTPKEIDNILIIANERSIGHGHCVRFENKRYLPHRNGELVYLPPHTKVLVIKSFTGRLYMTTDDDQVYDLFCVPKEQFMSAKFDLTPVAAPAPKRTKKIPAITHPWRRANYRDYLDSLGINRTRVKQLVAERYPYKNSQAIQV

SEQ ID NO: 8063 - protein, 180 aa, Lactobacillus casei
MRGKHIIIKILIAGAAILAVMGLQGGGVKTKPISLTAQQTVVAQQSQKSVPLFQQMAVFPDGCQRPLAGGIFAFYRFDIKGRKQYRMKNGEWQLVGNPLTAKGVYLAQADQLGIVGITQKLDDGHFYVERLRLPERYAVRLPSPVKVYVKQEALTVNGQPVRGRNSLPRIYALRVPVTRQ

SEQ ID NO: 8064 - protein, 185 aa, Lactobacillus casei
MAEKYTAEIVPLNAEKIGTKPHGTAEFTVDGAQLRIHIEMFDTPANVQHWEHFHGFPDGKPAEIATAAQDANGDGFVDLPETEPVSGTTMVPFDAEPAKMHVPNDSYPVADAEGHYAYEKLVDLKELQQAFKAAFGSEDLQLDKRVIYIHGVPDSLKLPDTVKGTVMNYDAHVTLPIAVGKIVRA

SEQ ID NO: 8065 - protein, 289 aa, Lactobacillus casei
  misc_feature (4)..(4): Xaa can be any naturally occurring amino acid
CAAXAMINTERMINALPRTEASESELFIMMNITYMLVHKPKYFFWKAIGVWLIAIGAMYLVDAFGEHIRLNDMLQNIYRGLVLFGILLLLNWLFIHQKVSWKPSLTIFNALLLGIPTYLFVCYVTYIGSQQLHLDYDWPFAISVGLAAGPFEEYLCRGLLLGLLLKTFNRHSKVTQIWMAVLISSLLFGLLHAINLSYQSLNTTIFQMIPACLGGVFYSAIYLRTGTIMMAMLAHGLWDFILNLVRPSLFHIPVALTGAVVIADVLEILISIFYLRKSKIRTIQLEKLT

SEQ ID NO: 8066 - protein, 399 aa, Lactobacillus casei
MPDLAQSTFILPQDAALTSAQAALKQHIHDFITTNYPTSQTHLLIISGDAGSGKSVVLDAAFAQLQQAARADSGPLAGTDNKLLVNHNEMLKIYKEIAGTKAYFHKKDFMKPTPFINAYRKAGKKADVVFIDEGHLLLTAPDPYNNFRDANQLADILHLARLVVLVFDFHQLVKLKSFWTPALLKRITRDYPVTHYRLTEQMRVGDAAVNRWIDHFVRGRIMPLPQPTNFDFRIFADGQPMYQLIQQRDAAVGLSRMIATADYPFTVLDNKTWYVTAGSLRLPWDKINFTDRPWAQRPETLHEVGSIYTIQGFDLNYAGVILGPSLGYDKQRDRLTVNLAQYQDKEAFKKRPDLADTQDAKAAIMMNAINILLKRAKHGLYLYAADPALRERLLEVAKR

SEQ ID NO: 8067 - protein, 351 aa, Lactobacillus casei
MPSIADYPQRPSLASFQQAPLTELDAGLFAQLGYLNFNYLIGQPYARFADLNDSMRLHKATLTTWAIPTHQAMLHAMHQSKRFARVAWTNWLETCSHRNEEDFAAITFTLAPDVYCVSFRGTTNKLVGWKEDLNMSFMPTIPAQRRALSYLTKQISRHPGTYYLTGHSKGGSLATYAFDHLPEPLADQVAHVYSFDGPSGVPLDPSHRDRVTKLVPQSSLIGVSLDPATNFEVVKSRVKLFGQHDVLTWSIADDTFTHLPTTTWVSRYFQKTFALWLAGLDATATAITVDALYRILRSGNAITLDDLAKTKNHWRHYFHAFRSLDKHHRKQLGRSFRGLLGAMAGSLVQTH

SEQ ID NO: 8068 - protein, 218 aa, Lactobacillus casei
MQFSDKLKMARQQQHYTQTQVAEQLHVSPKTISSWENARSFPDIGTLVKISDFYDISLDRLLREDQTMMDHYEAIDKQAIRDKRIFQFTYFTNLILLLGIVSLKMLTVMLPWVRQYAIGLSLIFIVNLIVLATHYPDYHQWVRSRPRLALFLILLVGLTTTLIFIGLYEPITVPGGDNSYAQEAYIAGSRMGIVLRGIAVTFSTIFIVFGSEEILDKN

SEQ ID NO: 8069 - protein, 215 aa, Lactobacillus casei
MQLSDKLKLARQQQHLTQTQVAKQLHVSAKTISSWENARSFPDVGTLVSISDFYNISLDRLLREDRTMMDHYETISKQAQRDNRYFQVTYYLNVILILGILAVKSFPANTRQLSGWLAIALIINLVILATHYPNYHAWVDSFSHKLLLTVLGIGLGVVLIFISVEGSMTLHIYKSISDEAAYLFGYYSGLLMKPVAETFSIIFVIFGFAELKEKP

SEQ ID NO: 8070 - protein, 109 aa, Lactobacillus casei
MQPSSQMLKGILEGAILKIIQQGDIYGYALHEKLAALGFGDIPEGTIYPLLLKLQRNKLIIGVRRPTGNGPDRKYYHLTDEGKKTLTIFQQQWHQLVQAMANLNQGGES

SEQ ID NO: 8071 - protein, 261 aa, Lactobacillus casei
MKKLNQLRAANDQQLKKIHGTDYSYTESVIIYLRSKLSKDPYAIEEAISDLLATLIDAQESGHRVASFFSDDPQKAADQILEELPPVPAWYLSNQYWPVIMFFFTVSSFIMLASQKTQLSLGNIAALLTVAFAFVNMPFARGLSFNKLSRKTVYSAMLGFAMMIIALLILSYLVAGRTPFSVSRSTLMLFSVSFLVLNLIGALGFRKVAHLFLAWTCVWLLAFIGMMLPTSPLTVGIAITGVLVATLLLFYHSEPKSQLPV

SEQ ID NO: 8072 - protein, 267 aa, Lactobacillus casei
MKKLTQLRTANDQQLKKIHGTDYTYTETVIQYLRGDLRKDPYAIEQAISDLLATLIDAQQNGHKVADFFSDDPQAAADNILKELPHISITYLFTMYWPLLMFLLIQNILIMLISPSLRFSLSDVIGINFFALLMIGASFARGIFFNKLSRKTIAGLWILLVLMFVVPFLTGYLFRGVAPFAISSPTLIRFSAILCAINLACALWLRPIFLIFLGWTGVWLIAVLGLALPSSELTVILGIAGIVCALGLLFYRPDPLHSSTNGTSIHS

SEQ ID NO: 8073 - protein, 96 aa, Lactobacillus casei
MNKKETQLFQAIDTAYNDPEMTAYPQIRRDLLMAAQELQNGTAYQIVAVKLKRTISRYVLLNHLQMPAAAGRLFIAIGPMGERYNGEASVFSLFFR

SEQ ID NO: 8074 - protein, 55 aa, Lactobacillus casei
MNAKEALISTCVFTVFLFGVDLFLGGHFQVFRNLFTGVVFFLIVWISGYLFHKEA

SEQ ID NO: 8075 - protein, 325 aa, Lactobacillus casei
VKYRLLGKTGYKVSEVSLGTWQLGGKWGAPFDAKVARETLEEAYAHGVNFFDTADGYQGGESEKMVGAFVKQHPDVHFTTKIGRKEEPLTAEHFDPDHVRRYVDESLQNMGLDSLDIVLLHCPPMQVYYQPETFFALDALQKAGKIKHYGVSIERAEEGIKALDYDTAVVEVIFNMFRLRPAETFFPLAKQHDVGILARVPLASGLLTGKFDENTKFAPTDQRANNRHGEHFSKGETFSGVDYLTGVKAARELKERLGSDNLAATALRFILMYDAVSAVIPGASNPTQIERNTDAADVPPLTPEQMAVVKDVYDRIIKNPVGYEW

SEQ ID NO: 8076 - protein, 451 aa, Lactobacillus casei
MTSKSNQAAQGNPPLSEKHHMQIPWYDVIVSEERQADHATLEERASLVGRVGIMLLACGTGAWRVREAMNTVARALRMSCSADIGLISLSYTCFSNNHAYSEVLSLPQSGVNTDKLDALERFVREFDTQYAKETVRDIHHRLDQIQKMSGNYDPLRAGLAAALACCAFVFLLGGGPIEMICCFVGAGIGNWLRGIMIRRNWTLLACIGVSVAVACLVYFLVFRGLEMSLGIAARHEAGYIGAMLFVIPGFPFITSMLDISKQDMRSGMERLLYALMITIVASLVGWLVAMVVHLRPENFADLGLNPALLLVFRLIASFCGVFGFSVMFNSPRRMAVQAGLIGAVANTLRLELVDLNTIPPAAAAFIGALVAGLIASAINRVDGYPRISLTVPSIVIMVPGLYIYRAVYNIGLNNIGVGAEWMTRAALIIMFLPLGLFTARLIMDSRWRKSD

SEQ ID NO: 8077 - protein, 459 aa, Lactobacillus casei
MIDLKKLETTEFYNHRYRNFSTMIILPTAILFIGLLLFLIFAKREVTVTIAAEIAPVKTAVTIQGTAANRIVTNHMKEGKRVKKGETLLVYHDVANHAQLKVLNQQLDTLKDQKGHLDTLNRSIAANKDLFTSADKFGYQQQVRDYLNQRRVYELESEAVNATQNVANAKNKEIDQLLRTSMQASEDKIAAIREAQNAIRTDQPLKADHIYSYLYAQYQAEAKNTETANLGNLKGQYQSQLQNLLTSEKEALAALKTQRANQKQADLSTQQTGQNEAKLASLQNKMQQTIAAEQLKVQQAIQEGEAKLTALKDQRNNYQVKAPADGILHLEATLSGNKYIPTGTVLAQILPDLAKQKEADLKLAVSPTEVMSLKRGQNVRLRIARNVPTPMTVTGRIYAVDVAPTVNPKTGNYFKAQARVHLSKTHQQSLYYGIAGEATVITGTKTYWQYFVDKMFNRQ

SEQ ID NO: 8078 - protein, 730 aa, Lactobacillus casei
MFKYKFKLGQAKYFKRYYTPQVDERDCGVAALNMLLKFHGSDYSLAHLRQLAKTDQEGTTALGIVRAAQELHFETKAVKADMTLFDLDDAPYPILVHVLKRGELSHYYVVFKATKDHILIGDPDPSVAMTWLSKEEFAKEWSGVAIFIAPEPQYQPRKEDKGSLFAFVPLLARQKVIIANIIVAALLITMISIVGSYFLQSIIDTYIPSAMRTTLGMIASGLILAYILQSVLTYGQNFLMAVLGQRLSIDVILGYVRHLYELPMSFFATRRTGEIVSRFSDANKIIDALANTIMTLFLDVWIVLILGIVLGIQNTTLFLVSLIAVPCYLVIVFAFQRPFNRLNQETMESNAILSSSIIEDLNGIETIKSLTGEKVSYERVDREFVTYLKKSFNYAKADQLQQAIKGLLKLVLNVVVLWIGASLVMANKMSLGQMLTFNALLSYFTNPLESIINLQPKLQMAKVANNRLNEVYLVESEFKEQRHLTDRSLIDGAIIVNDVSFKYGFGQDILKHVHLEVPANAKYTIVGMSGSGKSTLAKLLVGFYPVETGRGKITFNGAQIDDVALTTLRQYIEYVPQEPFIFSGSVMENLTLGSRADLTQAQLEDACAVAEIATDIMNLPQMWQTKLTESGSILSGGQKQRLAIARALLSPAKVLIFDESTSSLDTITERRIVDRLLAMKDRTIIFVAHRLTIAAKTEQIVVMDHGAIVEQGNHAELLAKQGYYARLVSE

SEQ ID NO: 8079 - protein, 48 aa, Lactobacillus casei
MTDQKSIQKETTMSDYSLSQVRGGTNRVSSQPFEDLKSWIAGLFRGKQ

SEQ ID NO: 8080 - protein, 452 aa, Lactobacillus casei
MTRMQKINWPILKETGVFNMVSLPGHIYFFINWPVFIFGIGFLSYIFFCRIRPLHVALWSITGTTLSLFFLTYGEISFCLIYAWYISKTNQSSDKFWVFIFMEVNLIIITIQTCVIRTFAAAGIKHLILISVVTTLILTAILAVIVIWLLVKKQTQLDQLRMLIREQNHLQKSVILYTGATCVSLYCFEAISNLVNIGIMLDLLILGIFTLSIIINLYSLFLILKSFSYYVELTWIKRAEASQRAYYTTLSQQQKNTNKLLHDYKNLLASLQLSLQQSSSTISPDTQAILSRAQASLNQAELGKSSFTSIKSDPLKSLLYLKWAESMNHNVIMNVQTKGIIHPLESALGFAIIRALGILIDNALEETVRIKHHRFNVTLIALEQGLEVSVINDVDPDFNLANLEKKDFTTKGDGHGNGLSIINELMQQNKNILIRKSVINQQLKITLFIGDS

SEQ ID NO: 8081 - protein, 268 aa, Lactobacillus casei
MTTNRTTLKIFILEDDATFLRFIEKTLNNYIMIEELHAEIKIATQSATDLLNAIDLQQINDSFFLLDIDIPGSSINGIDIANIVRKHSLYADIMFITSHTEQALAILSQKILPLDLVDKSVPAEVETRLRTNLVQGIKRLRSRQLESPRLFSYQIGANLFSLPLDDVLYIQTVLGTPSTLELHAKHETTTFPGNLKEVSTRYPTLFRCHRSFLLNPLHVHKLNASGRFVYMDNQDKLDVSIRKVSALRRLMAAANRSHAEANNLADDA

SEQ ID NO: 8082 - protein, 93 aa, Lactobacillus casei
MPSKDEIIVAMEKLAIKLSMCHKNSETALFVDRELEVLKTCDGLAFHNKLQYFFNTAVIKLSDSISFSESEKTFWDAVFEYKQLGNYDWIASE

SEQ ID NO: 8083 - protein, 124 aa, Lactobacillus casei
MITVQENVALALQKQELLGFPFRSISRILFGFVRTVARAVIGEIEGEFTYMKEMAAFDHKRLRQPLSIWIVQICLFTLLWIMSDDASWQVYAIILIAILSNSYDFLRKLFTMTRAYDRQRNNKE

SEQ ID NO: 8084 - protein, 63 aa, Lactobacillus casei
MNMTKTLLLVIFVLVYLLGVLVYTLSKKNGHYRVWNDKYLDSDNEISFIRAYVLNAIWFITYA

SEQ ID NO: 8085 - protein, 52 aa, Lactobacillus casei; identical to SEQ ID NO: 8022

SEQ ID NO: 8086 - protein, 65 aa, Lactobacillus casei
MQQFVTLDDSSLERISGGGTDNFWTYIGMGLGAIARSWVQGGFVAPAMSLSIDVLNELKRKENLP

SEQ ID NO: 8087 - protein, 211 aa, Lactobacillus casei
  misc_feature (4)..(4): Xaa can be any naturally occurring amino acid
CAAXAMINTERMINALPRTEASESELFIMMNITYMPQVALWGIGFVRPNNPIFLVIWYVLTFFYMFVSYKYLAAVSYLKPSPSKIFIGLLGGILVLILEVIFAELFPNIQGSQLDPNMTPFIPLYACICGPLWEEVLFRGILNKRIFRGSILGLVVSSLGFSLLHDYLSPLIILYFLMALIFSFCNRGKTDISASIVAHMVVNTVVFFLNF

SEQ ID NO: 8088 - protein, 61 aa, Lactobacillus casei
MTKLNGEPFHALTRRTLEKVVGGNAFTKFDDLLWNKTLIEPVHLPGKRYGLPIVRPILQES

SEQ ID NO: 8089 - protein, 61 aa, Lactobacillus casei
MKIRTVSIVLVWAVFLTATMWLMLSDLKVLPRVSLIDRYYWLLLVLFILIAGTNLINRLKR

SEQ ID NO: 8090 - protein, 50 aa, Lactobacillus casei
MVKIVLNTCSFLFCVLLYLLGRGNGPSLNVVSIFLISKSLSPFKNLFQGS

SEQ ID NO: 8091 - protein, 252 aa, Lactobacillus casei
MLQSQNVLHIYILEDDPDYLTFLYKMLQRRISFEEWPAKIELATTSPNELISNIDQRIANDSIFFLGFGFTNSLKDGVDVALAIRKKSLYADIIFVTGHTEQALTILSHKIAPLDLITKDSSIPVDSLVQDNVEYSLKRLRARKLMSPRLFSYSMDSSVFSFPLNEIIYIQTIPEKSSMLEFHVKSESVPFSGNLKDLTLKYPTLFRCHKSILLNPLHVISVNTSERFAYMDNHDKVEVSFRKMVALRQMLR

SEQ ID NO: 8092 - protein, 56 aa, Lactobacillus casei
MNELFVEMNTEEMANIMGGKNWVKCYAGTIGSALLGSAGGPVGYWGGAMVGYATFC

SEQ ID NO: 8093 - protein, 182 aa, Lactobacillus casei
MTHEVKCPKCITGFVAFILSMTLLTTIMKPNVVDASNVGQTDVLGKQFETDVTETQYVSNIQGVVKIDGWKLIELLKSKTSFYLFIGYKECPYCREFSKVLKDFIPQMDRPIYYIDLDTSLNDFEGSKEAVMLNILNNQIHFYGTPTFELLIDGVAEKEFVGSATTLADLQYLKRISMSYAN

SEQ ID NO: 8094 - protein, 276 aa, Lactobacillus casei
MKFFAKIALIFFMMTAGWFGLQSNRQSSVAQGQTGKTNQVPTLFVHGFGGSYASEKGMIDGLSQYAGYQEVLYYLIKRDGRLVVKGKWRPNVKHPLIAVVFESGNPEDASALGKILKQLKTRYGVRYFNAVGHSAGSLGWTYWASQANKTGMPSLKKFAAVGGPFNAIPGMGVNSGKTVTKNSKGQLQKMSKQYADFYRNRQFFPKTAKVLNLFGNLGDGSDGRVPIGSAKSLRYLVADRVREYTEHEIRHRAQHSQLHQRNKVVNAHLYKFLNQK

SEQ ID NO: 8095 - protein, 147 aa, Lactobacillus casei
MAFSVAFSQALDIAAYVNAKSQDQRDQYLSIQKISEMLNIPVPSIKKISATLKKNGILSSKTGLNGGLRLAKPADAITIYDILIAIEGRTPLFKIHEAVDPSAFVNGTRVERWLDASSKVLNQAEEAMLKVLKNTSLADLAKGSDRD

SEQ ID NO: 8096 - protein, 479 aa, Lactobacillus casei
MNKTEDKEVAAADRLVADESLEDTDLTESKPIKTNIMSITQRIILGLALIGAFLGVLDTSIVYTGTVKMAAQLQLNANALSWVQVAYALTYAGFMLVGGKLGDIYGRKPLFIASLIIFGIGSLVVGAATNAPIMIGFRAIQGIGAAVLAPNCLALLTDTFQGKARQRAIGYYASVIGAGAAVGLVIGGFFATFASWRVGFYINGPIALLMVIIAARYLPSAKRQTGKIDWIGTILSVLAMTSISYGLDGSPWPVMTLLISLVLWGAFIISQGRVAHPTMPLEIFTDKERMASYVSSLLFSAAAIGFWFYTPQFMQKALGLTPFMTALGMVPMAILLFIVAVRARTFVDRWHNSSVMLFGFVVVSLSLAELVVVSRFANYWLLLLGTLGFAVGFALAFATLATSGLARIRPQISGAASGVYNTARQFGGALGLAVFAATTGRLTNIADVFGQAMLIGVGMTLVGIVLVLTLIIPAEKRSA

SEQ ID NO: 8097 - protein, 112 aa, Lactobacillus casei
MPDKRETLLDLLSKAYSSPTIKAQADLQALIKINAKKLDEGDDDKAYVTAVTQLSHDISMYYLIHHTMPKELVDIFNFIKKDVAISEADAARYRKQALAAGLGAMPIVWGGH

SEQ ID NO: 8098 - protein, 58 aa, Lactobacillus casei
MIITADMVLRVITWISAISLVLYIVAAAFKWLPSSDFVVPMLLLSALISYFVSSIDEE

SEQ ID NO: 8099 - protein, 317 aa, Lactobacillus casei
MKQVRLGGSNWQASSVALGIMRMNVLSPEKAAIVLDSAYNDGINFIDSADIYGQGKSEEVFGEALKQSGVNRDQLYIQSKIGIVVDPDRSHGSLVFGRRYDFSKEHLLGAVDKILERLQIDYLDSVLLHRPDPLMEVDDVAAAFDELQQSGKVRHFGVSNFNPEQIALLQSGIHQHLLIDQVQFSVAHTGMVNAGMHTNMEDDRSIDHDGSLLPYLQRKQMTLQAWSPFQYGMFEGTFIDSPKFKDLNDELQKVADHYHTNKNAIAVAWLLRHPVGVQVILGSMNPEHIKESAAGADITLTRQEWYNIYFAAGNDLP

SEQ ID NO: 8100 - protein, 243 aa, Lactobacillus casei
MTVKDKVVVITGASSGIGAATTQVLAQAGAKLVIGARRTERLAELAKPFGDQVRYQATDVTDQQQVKALVDLAINTFGHVDVLYNNAGLMPLSELSELKVNEWERMIDVNIKGVLYGIAAVLPHMIAQHSGQIITTDSVAGHIVHPGTAVYSGTKWAIQAIMDGLRQEQAANHIKTTMISPGAVNTELFSTISDPKRREAVESDEKNNGLSATDVANAVLYAIDQPANVAVNEVLMRPVTQQR

SEQ ID NO: 8101 - protein, 391 aa, Lactobacillus casei
  misc_feature (5)..(5): Xaa can be any naturally occurring amino acid
NADHXIDASEMSEYSFLKPFTFKHQAIQLKNRIVIPPMTTRLSFEDGTVTSDEIRYYQERAGGVGLFITGTANVNPLGKGFEGELSVADDRFIPGLSKLAAAMKTGGTKAVLQIFSAGRMSSSKILRGEQPVSASAVAAPRPGYETPRALTTAEIEATIHDFGQAVRRAILAGFDGVELHGANTYLIQQFFSPHSNRRTDEWGGNRDKRMRFPLAVVHEAEKVIAATADRPFLLGYRISPEELEEPGITLDDTLALIDALKTTKIDYLHVSQSDVWRTSLRQPNNPAIVNEVIRDHVAGAFPIIVVGDVKTPADAEKAAQAFDLVAIGHELIREPHWVQKVLTHDEKAIRYQIAPEDLDELGIAPTFLDFIESISGGAKGVPLTTALADDH

SEQ ID NO: 8102 - protein, 105 aa, Lactobacillus casei
MKNQKMGCAGLFAILVVIAILIQFWYIVLAIVVLGVALYLYYHRKQQEAAAQAAKTAQEQADEQATIAKLKAYKDLLDTGAITQDEYNKKKAELLRLDSHDELKF

SEQ ID NO: 8103 - protein, 458 aa, Lactobacillus casei
MTKTRTESDTLGPVEIPETALWGPQTERSRHNFQAGPLMPLAVIKALLQIKKAAARANVAADVLPAPKGQLITRAVDTLLALPDSQLRQDFPLHVYQTGSGTQTNMNVNEVVSHQAAKLNPDLPILPNDDVNRSQSSNDTFPTAMNITAALAVDELLKAVAELHAALQTKAETYAKTVKIGRTHLQDATPMTFGQEVSGWAAMLDHDQAAIKQLQPALFRLAIGGTAVGTGLNAAPNFGRIVAGRLSDVYGLPLTAQTNKFAALAAHSEISLVHGGIRTLAADLLKIANDIRFLASGPRAGYGELTIPANEPGSSIMPGKVNPTQAEALTMAAVRVLGNDATIAVAASQGNFELNVYKPVIISTFLESTTLLTQTVTSFTTKLVDQLTVNEPRMKALVAHSLMTVTALTPHIGYEKSAEIAQLAEREGTDLETAALKSGYVTSAQFDAWVDPAKMTGI

SEQ ID NO: 8104 - protein, 260 aa, Lactobacillus casei
MMQDESGDGMESSKELGNDVETDEGTAMLSQHATDLLIGLMYADHLDVESSYEQRTIFRGGKDFFATFAPLTGIKNRTTLKRARWELQACGALLSDQQQTHKHYHLAQTPWQIFKQFNGIMASPVRASRTYDAGTFAELLKLSGVDRKNFPLHTEGVVMLQAATFGSDQPLMYAVSQSAYDRLLKAELALKIAGSTPDHPDRRLVSIQTWSTDPALVSRWLHAGMPTPQADPLHYYLSVLSSSSVELKKDAAQLVAALLH

SEQ ID NO: 8105 - protein, 535 aa, Lactobacillus casei
VSDDHKKKHSMKLIQYANGPSLEEINGTVEVPHGKGFWRTLFAYSGPGALVAVGYMDPGNWSTSITGGQNFQYLLISVILMSSLIAMLLQYMAAKLGIVSQMDLAQAIRARTSKTLGIVLWILTELAIMATDIAEVIGAAIALYLLFHIPLVISVLITVLDVLVLLLLTKIGFRKIEAIVVALILVILFVFIYQVALSDPNMGALLKGFIPTSETFANSPSVNGMSPIQGALGIIGATVMPHNLYLHSAISQTRKIDHHDPDDVAQAVKFSAWDSNIQLSFAFVVNCLLLVMGVAVFKSGAVKDPSFFGLFEALSDSSTLSNGVLIAVAKSGILSILFAVALLASGQNSTITGTLTGQVIMEGFIHMKMPLWARRLVTRIISVIPVIVCVMLTARETPIQQHEALNTLMNNSQVFLAFALPFSMLPLLMFTNSKVEMGDRFKNTGWVKVLGWISVLGLTYLNLKGLPDSIAGFFGDHPTATQTTIANDIAYALIVAVLALLAWTVWDLYKGNKRYEAHLEAVADAKEAKASDDVQ

SEQ ID NO: 8106 - protein, 905 aa, Lactobacillus casei
MEEVPDAQPPATAHSIKDLQQQLQVPSLDHGLSKAEAAERLKVNGPNAIESHPTPKWLIFLRQFNNLIIYILMIAAILTTIIGDVTDTSVIVLVIIVNAIIGYYQESNASDSLEKIKKMLTPEATVYRDGERLDIPSADLVVGDVVFLEAGDNVPADLRLVDIDNLTIQEAVLTGEANSVIKTTATLPADTPLADQSNMAFASTAVAGGSGIGIVVATGHDTEFGKISQAVSDVRKGRSPMMREIDGIGKGISYAIIAAAVLLFIFGLIIGKYSLPVLALAIVTMVVGSMPEGLPATTSVILAMGVSNMAKKQHVIVKTLPAAETLGSVDVICTDKTGTLTKNEMTITTVVTPKATYEVSGSGYTPKGTFTLAGKPIEPTAHPDLIALLTAGFEANDTELHQEDGRYVINGEPTDGAFLTAYYKVFKKDPDNTERDLMPFDSNNRYMAKLAKCADGKTRLFVKGSPDKLLPLVAIAHPDFDTDHYLKLTSQFSVQGQRVIAVAESVVAPDTTEITPALLNQGLDFLGLTAIIDPPRESVISAIKQMRRAGVKVKMITGDHPETALAIAQKLDMADSPKAMTGAQLAALSDDQRQQAILDTDVFARTTPKDKLTIVTALQDAGNVTAMVGDGVNDAPALKKSDVGVAMGQSGTDVAKDAADMVLTDDRFARMETAIAQGRRIYQNIKKSILFLLPTSFAEGLVIVFTILTQQAMPLRASQLLWINMVSAITIQFAFIFEPAEAGTMDRPPRKKNASMMHKHDVFQIAYVAMMIAGIGLWAFDWLTANHLTDRVTASTMMVNMIVLGKIFYLFNIRTNTLALSKNFFSNPMAFVIIAVMLALQCFLTYVPFMQDIFQTASMSWREWGLAVAAGSIILIVTEIDKIIRIRWDRLHGHGAFPSVSKTNE

SEQ ID NO: 8107 - protein, 121 aa, Lactobacillus casei
LKLYQGLTQVQINEEFAGEASGYKITTTLDKPLNYEPTILYQYLDTVLRPGSRHDQNNLRYVTDPAFIGENFDYQSVPFTSHMTDFDEKMAFARKLVADLNRHLSVNIKPADAEIELVFVD

SEQ ID NO: 8108 - protein, 434 aa, Lactobacillus casei
MSISQSSLSTAYPAFMKAFGLGADTVAWLTTGFMLVMTLMIPVSPWLLHNVPFQRLFQAIELIFAIGTGLCIWAPNFTVLMIGRLLEAVAVGIIFPSFQTVLLTITPHSERGKVMGTAGLVMGSALAVGPIISGILLTWFPWQALFLFFLIVSLLVLAVSTVTIASVMPMAPTRLDWVSFILSASFPILLYALSAWSKQGLHAGVVGLLILGVLAAGIFVVRQLNRQPPMLQMRVFATGMFTKAVFLTGISYIGLIVTTILMPLYFQTLLGLSPLVSGLSLVPAAVLLSLLNPVSGRLLDRFGPRLVAMIGMVLITGGFGLLAIFAHHLPLIGAIVLAMATEAGNAFVMMPSVTAGANALPNDLVADGTAVTTTARQLFGSAGVMFATVLLSNMQTTLHSNAGGFVVTFAVFAGVGLIGLLLALTLPKTVAKAQ

SEQ ID NO: 8109 - protein, 510 aa, Lactobacillus casei
MMKTYTDYFFDEPAFDLHDGGYVPLEVSDAPAKPLNVPPLLKPDKETATDVYYTVTAEAGETQLLPGPKTKTWGYNASLLGQTIVYRRGQHVHVTLKNALPEVTTFHWHGADVSGPYVDGGCHAPVYPGESKQIDFTLDQPATTLWLHAHPCPETAEQVWHGLAAMVIVKDDHEERLPLPRNYGVDDIPVILQDRRFHENNQWDYRADYDPDGVAGPTVMINGTVNPYFDVTTQKVRLRFLNGANRREWRLHFSDDLPFTQIGGDGSLLPEPVSLTHLMMTCAERDEVIVDFGQYHEGDEVTLFTDDVPILKFRIHAFKPDHTQLPDKLFTVNAPAVDPALPIRHVVMQGMDESVAIDGKKFEMQRIDATQPIGKAQYWDVTNSNEAPGMVHPFHVHGTQFLVLSRNGHAPYPNEHGYKDTIGVNPGETVRLLVRFDLPGVYMYHCHILEHEDGGMMAQIETFDPNKPKQEYKLMDMDTLMKALAKERGVKPSELWMGGMQSYEKMGMKM

SEQ ID NO: 8110 - protein, 66 aa, Lactobacillus casei
MQTMSKSMGWFMLALNVVLLVLIATMHNMAAMWLMGIIMSLDAISGLISAYHADRETHHQGHAPQH

SEQ ID NO: 8111 - protein, 209 aa, Lactobacillus casei
MQPLSITAKRDMTAAIRVEYFSTAWMAFEFIIGFWSGLQAGSILLIAFGLDSFLEIISGATLIWRLKKENSGAPAAVVAEAERRSSLVVGSVLLLLSLYVVGVSGFNLVTHAAAESSFSGIGIAIASVLLMPILTLKKRHLGQKLASAALVEDGMCNITCAYMAATVLLGSLLTWLLNWWWADSVAALILVYFVASEGWESLQTGLDRD

SEQ ID NO: 8112 - protein, 110 aa, Lactobacillus casei
MTANSLKLVESAKLVEAERIFKLLSNPIRLQMLKLLEQQELNVSKLGDLLGLEQSVVSHQLALLRKHQLVSAKRVGKANYYRLDDPHIITVIDAMLAHADHVARGKRHGE

SEQ ID NO: 8113 - protein, 313 aa, Lactobacillus casei
MKKILITVGALIVMIGGVFWFVNSRSNAQKDAASTGQKLRVVTTNSILEDMVQNVGGERIKLYSIVKRGTDPHEYEPRPTDVAATSEANLVFHNGLNLETGGNGWFKKLVKTSHKAFGKDVFSASAGVTPEHLTTNVKEEDPHAWLDLANGIQYVKTITKVLKEKDAKNADYYQKNSDQYVAKLQKLHKTAQSRFLDIPEKQRVLVTSEGAFKYFSKAYHVTPAYIWEINTEAQGTPEQMQTVLAKIRSSEVKHLFVETSVSPKSMNKVAKETGLSIYSKIFTDSLAAKGKQGDTYYTMMKWNLDKIHDGLAG

SEQ ID NO: 8114 - protein, 297 aa, Lactobacillus casei
MNSLIEFFNALGKYDFLQSALVTAIMVGIMSGLIGSFIILRGMSLMGDAISHAVLPGVAVAYMLGVNVMIGASVFGIIAALLIGFVAANSKIKTDTSIGVVFSAFYALGFILISMAESATNLHHILFGNILAVSDSDIMTTAIVLGIVVLFVVLFYKELLITSFDNTFAKTYGLNTTAIHYALMLVLTLVTVSALQTVGIILVVAMLITPAATAFLWTDRLETMLVMAASVGVISSITGLYFSFTLNWASGPAIVLVAAVLFAISFIFSPKQAFFSFSKRQRTKEAATTQTAEEIVR

SEQ ID NO: 8115 - protein, 247 aa, Lactobacillus casei
MLTVKNLTVAYADTPVFADVAVHFNAGKITGIIGPNGAGKSTLIKAILGLIKVQSGTVDFSGKTLKEVQQAIAYVEQRKDLDLTFPINVLDLVLTGTYGRLGLLKSPGKKERQAAYDALEQVGLEEFTKRQISQLSGGQLQRVFVARAIVQQADIMILDEPFVGIDMKSEQEIMTILNQWRDAGKTLIVVHHDLNKVSNYFDELVVMNHGIIAEGPVEEVYTARNIERAFSADLSNVLFATKEGASA

SEQ ID NO: 8116 - protein, 89 aa, Lactobacillus casei
MAKKSKIAKAERQEKLVQQYAAKRAELKAKGDYIGLSKLPRDSSPVRLHHRDALDGRPHAYMRKFGLSRLNFRELAHKGQIPGVRKASW

SEQ ID NO: 8117 - protein, 309 aa, Lactobacillus casei
MMKRLLAGISVVLLAIFGVACGNNGAAKQSNSSNSKIQVVASVDFYGEVAKAVGGNKVSVQSIIDNPAVDPHDYEPTTKVGKSVAQSDLVVASGIGYDGWMDKVVKSENKSKNYLKVADDLMGKKEGDNEHIWYDPRTMPKLANALADRFAKKDPADKAKFKANAKKYIASLDDLNALINKLKANANGKLVDVSEPVFGYALDYMGYKVNDEHFSKSTEDGTDYSAKDIHGIETDIKEKKIAFFVNNIQASSKTVTRLVKLAEQNNVPVLKVTETLPKGKNYRTWMTSQYEQLEKIQDQSSSSATSVSK

SEQ ID NO: 8118 - protein, 74 aa, Lactobacillus casei
VLASITRSLAQESACKDLSRNEQARVIAPEAAYTPTPKRADSRSHKKSTHRLRCVLSFWPGLSGAFDPELWFVM

SEQ ID NO: 8119 - protein, 213 aa, Lactobacillus casei
MANVMILGAHGQIATLVRQRLLKETQHHLNLFLRHAERLQNVNDQRETVVDGDVTDTPLLTKAMNGSDLVYANLGNKGIENQAKSVVQAMDANNIKRLIWISTLGIYDEVPGAFGRWNHKMLDGGYLETYAAAAKVIETSDLAYTIIRPAWLSNKNIVSYEITQKGEPFKGTEVSRRSIADLVVNLINDPSQHIGQSLGVDQPNTQGDKPSFY

SEQ ID NO: 8120 - protein, 654 aa, Lactobacillus casei
MQIQNRIRKYTSSWLLLTLLLASLTFLFSPLISPPTVVDAGKNVPVSGLNRNDATITDINQKDVTHTARLSRGQLYYLTYHWQISDGVTVNAGDTAEFSLPSSVLPQSDISFKILNPGTQETIGNVFVKAGSSQGLITFTDFFSQKTVKREGTLKLQVNGRFNDPDHQQVSWYINKAGWVVTPPKGNHAADSNQYVDSLGRPKLFQWQITLNPQGKTIHDVVLHDTLDAGQKFDTSHALTAATGTYSQNAFHQNGTIKVAPQVNGREMTIPLGTITTAVEVSLWTNPLSTSFGSFSGDKNTWNNQVTATGSQDSGLNPTAKGQITWNNTGVGIGSVSQVKLTKVGATRPQQPLKGETFALYRNDGKLVKNGLTTDKNGSLSISQLLAGQYQFLETKALAGYRLNRQPIKFTLTKDHPRVAIKSADMPIAPASSSNSSSTSNSSASSAKPSSKVSSSSKPSKPSSEASRSSKPSEPSSKASSSSETSEPSSKAPSSSTKPSNLPSMPSSTQSSASSSSHQVASSKSSSSVPESASSTGSSDSSASLKPSMGASSSAPTRESASSTSESHTSQPAKSAVTSSVASSDTALPTDSDTNTQSGQNDSSTETINPHGKHASKRWMILPNTGERLVSALSTAIGIVLTVLGSVLFFKNHR

SEQ ID NO: 8121 - protein, 300 aa, Lactobacillus casei
MMKRVLTVISLLLLSVVAGACGTTAKPSGDNDKIQVVASADFYGEVAKAVGGKQVQVTSIIDNPAIDPHDYEPTTQVGKQMATADLVIANGIGYDGWMTKLIKSENKSKQSLQVAEDIMGKHEGDNEHIWYDPRTMPKLANALAARFAKQNPDKKATFKANAKHYIASLGKLNDLIGKLRQNAKGKKVDVSEPVFGYALDYLGYQINNRHFAQATEEGTDYSAKDIHSVEEDIKTKKIAFFVNNSQASSKVVDSFIKLAKENKVPVLNVTETLPKGKNYRSWMLGQYQQLEKIQTQTGAK

SEQ ID NO: 8122 - protein, 49 aa, Lactobacillus casei
MSLIKHTFKRVEHLIATPRDPHEEEQARLQADLFYTNLSSLQPKTNARF

SEQ ID NO: 8123 - protein, 504 aa, Lactobacillus casei
VKRKVRWRNVIGYGAADLFGNGALTVASTWMLFFYTSFGGLSPVLGGTILAIARVADSLISPLMGYLTDHFGATKMGRRFGRRRFFLLISIPLMFIYVVIWVSHMGFWYYLFTYLLMEAFTALVMIPYETLAAEMTDDYDMKARLSSSRMLWSALATFLASWLPGRIFAIMGKNNPNAFLTLGIVLAIIFILAIGLTYFSTFERETDGTPEERKAIIEESRNKGENPLVTLWNMIKDMGSVFRIKSFALHLVIYLSSFTARDIVGATYVFYIVYAMQSNPTEASNILTVGSIIGIPCNLFWPKIMSKLGPSKLLRIMYLMMFFTVACYAGLYYGSAAGTSWGIMTLYALQVTWGISNSGTGYVPWTVYTFIPDVDEMVTKQRREGIFAGIMTFARKTTSALAPFLTGIVLSAFGFNESAKSQSAGALNGLILWMLLGTALMLLLAFVTSYFFKLDRESHKVLRDEIDRLKAGGKMSDVDPKVKAQVENLTGFKYDHLWGHNNIV

SEQ ID NO: 8124 - protein, 52 aa, Lactobacillus casei
MCICSKLSISLSQSENTRPKQALFLTNSVKRNFETMVDTGKFRVILVKRSMF

SEQ ID NO: 8125 - protein, 912 aa, Lactobacillus casei
MSNITAALYAPDHLSVNLQHFAYNVQQHPRFSWWNHSSFSDASQAAYQLVVFKRLQDRDHQTYLYDSGWVHSAQNSAVTAADLADSLHPGDLYYWQVRIKDNLGHTSDFSQPAKFICADPALPVQQGIWRQSQPKSGEELAHIGNVVFLHSPQLTIDTNDVDTAVVVAFARGNEPIFAQSFDLYVNGHCLGVGSARQQEHDHGTDRTAVYYNVYDATDYLESGTNTVAALATGSSDRRAFWCQLIVYKHDGTKEVVTTADPSWRALDGSSAFGDFGVKIRSQYFGMVSENIDMRYYPQNWASKTFDDHDWPAAWRNPQPMITDDEVLVPYRSENTERIEVHDANKRIVTFSPQNRLIDLGKEIIGGLTVDLASDTDQRVTVLMGEQLEDNGHVRHDMACGPDYVENWTLVKGENHFTTLQMKNFRYVELLGFEGDLHLDAINGWAMQQHFPDDESSFQSDSDLLNREYELSKYTIKATNQDVFVDSQARERRPYEGDLLVNANTSYTVSANYSLARHSLDYLIDNPTWPEDYKLFAIEMAWLDFLYTGDDTLLKTRYTALQYKLNRGKSAESFDGASQSFKGSLKNSKGVDNFDEKVGLVTNDGLVDWPISERDGFVEGTYNTPFNAIFYGAYSTMGKIAKVLHHDDDAAHYQDRAATIKKNLIDKLYDDQTGRFFDSLNADQTINRHTSHHASAYALCYGVYTNQAMADRLSQFVANDGQFVGSIYFIYFMLKGLFESGHAADAITLLTDPNDQKDHKSFAAILDSLKATIAPEAWSNHYKPNLTLSHPWGATPGLTIVQGIAGIMPIEPGFSTFRIKVRAGNLTHLNLTTPSVKGLITVHYQQDAGNQTLEVAVPMNAKAQVELPAQAQQVAVQDQFGKDWTIAVQRDDQTLTIPAGSYRITYQQGTVRK

SEQ ID NO: 8126 - protein, 65 aa, Lactobacillus casei
MNNNVKSTSKVRRGINELEALLAGNDPGFVYHTRKIPTPPSYSAEEIEISENKLKPSQQNYDPLS

SEQ ID NO: 8127 - protein, 117 aa, Lactobacillus casei
MKTNDLVSLYVAFVEGSGGKKRPVLVRSVTETRVTGFKITTKYANKSVFIRRQYYQIQDWQVVGLRQPSWIDIGRLYSFPKHGLHFKEIGHLTPRDQIDLDRFNTRFKEAQKKRSNR

SEQ ID NO: 8128 - protein, 91 aa, Lactobacillus casei
MAVQEKKRIQVQVDKELADDTEQVLERLGLTQTTAITMLYKRIVATGALPFKPALTENEKATLHFLKSTEDTPVTVFKDAKEVDEWLNEDE

SEQ ID NO: 8129 - protein, 82 aa, Lactobacillus casei
MNIDDATQIVFTTIVIIWILKTSKGKLDKRTKGLIWIINVLLITANFGAYFLTAENNQWALAYDLSFTFIQLVILWYFARNF

SEQ ID NO: 8130 - protein, 82 aa, Lactobacillus casei
MTFWDIVQIMFAPVVIIWIIATSKGKIDRRTKELIWIVVILVIVGNVAGYIIVTERSQWAIAYNYTFAFIQLVIMWSFARNF

SEQ ID NO: 8131 - protein, 506 aa, Lactobacillus casei
VISMLTMIKTSFKERARQHSFWLMIGTVVVLAILCTPRFNTGIKILSLDPKIFRQADNPTWLPICAALIFGFTLPFFGVGAVENALQTDRTSGVWPWIATTRFARISYGLALFVGNFLVLLSMWFVTLLATGLMVVIRFPGQGISFATFLSPFLALLPSMALIAALALLVESVTAKRSSGLVTVFMFGLLYVYATQLSEPHAFWHRLLSLSGLTSLQDTVSRASEHVIGRPIDGIQMFSSYAGQQGKLSLHFGPVAFDRTTLAFMLGEVLIAVGIALVAALLMHKARQTGGLKVRHQVQAPASSASVPADYVPIQAGHFQWLQLLQVEAKRQWHIGSWRYRALLLGSWLLVWFVPTAAQQEAGLPIVWLLALPWLSALGSSPRGWQSWLHTVPAAIQHQKWAELLVSGGLALVIMVPFIVRKPSVALQLILVAVATVALAQGMGSLLNSGHLLALLMALFWFFYMNGLTGMISPTHFSLIVCVVFAGLFIVGLALTELANRRRSLA

SEQ ID NO: 8132 - protein, 286 aa, Lactobacillus casei
MKLTTKNLTMQFHNKMALNHVSVTIESGGLVGLIGPNGAGKSTFMKILATLMRPTAGDVLLNGQSILRHPGKMRRVLGYMPQTVPIIPQLNATEYLQYLSALKGLPTTKANRQIKALLQQMHLQGVAHARLGGFSGGMRQRVGLAAALLGNPQIIIVDEPSAGLDPIERIMMRNLLSELAQTRIVLLSTHIVSDVEAVASQLLLLKDGQLVFQGTAPALIQAATGHVWEYVLPQGTEPQTDQAMSEMRQATDGIHIRTVAKQSPTPQAVAVTPTLEDATLSALESR

SEQ ID NO: 8133 - protein, 289 aa, Lactobacillus casei
MMKRLLAIGALLIVLGLAMLGIGAAHDGLQPIAVVHGQPIIANPTTKTQQVKPFSRLSVTANDMDVVVKTGAQYRVEVTSVGSGHVMQTVRSGQLKLTQKGKPIFGMMLGQTRAPQITITVPRDQAITAATVHTSSGNLTYAVAKTTRLKLSATSGDMTVSHVQQAQLQLQSDSGNVRVTNATLHEPKVTTKYGDLFVTDSTINQGQFTLSSGDFHMTHTELKGKNQVNNTYGDNVVTGADKQSGYALQTGSGDNKVFTRATTENNVTYNRRADTQLRLVTHNGDNQVK

SEQ ID NO: 8134 - protein, 206 aa, Lactobacillus casei
MSSEAYFQALMQILSPLTGDERTEAVAFFQDYAEDGGLTDGDAITKALGTPQQLGRQILADYAIKSSTASGSAASPKANARQIKTIVLAILSAPMTVPVAIALFVIVLALLIVIAAVSLAILLVLAGATGLGLGVGAFSIFAGLFLLAHPMVALSYMGLGIAAIGVGLFLIPLLKWTTQGMFNVVARFFRWIYRRIRKQHLEVTQL

SEQ ID NO: 8135 - protein, 112 aa, Lactobacillus casei
MGMPLSAELLDGIVLAVLQQSDAYGYALTQQIQAVISISPSTLYPVLRRLKAQGALTTYDQPYEGRNRRYYRITPVGSKLLQETETNWQTFKQQIEHFLPDAGNQAKEEKRS

SEQ ID NO: 8136 - protein, 322 aa, Lactobacillus casei
MKRKFRFILLLVGLIAWFSVAVYGYTQTTTASTNQETVTIGYQKADPVDISRQRGELAKKLKAKGYQVVFKEFSDGAALMTALKSGAIDYARVGDTPPVTAKASGTDIALIAAGATKEYGSGILVGKNSGITSLKQLKGKTIAYQKGTAAQYLIIQALKKAGLSTNDVKLVNMDQSSASVAFAKGGVDAWVTWDPYTATAQVNNNAKLLTNGTGLSKNRDFLISTQSYAKNHTSLSKLLTTALNDDMTWANAHHTQLIAMLSKTLKLSDEVIQKMVERRTYSMTLINGNSTIVAEENAIAKTLYQAGVVTKEVDMKTTLVDE

SEQ ID NO: 8137 - protein, 510 aa, Lactobacillus casei
MSKLTDQLSQNLINHRDYPLVKSVASNTWYTGRDLEEDVAALREQFAEQKIGAGDQVLIVLPNSPVFLPLNQALWEIGAVAHPIAAKTPLPELLDEWTTYHYQAVITLPALGEAMEAPLIPWARVRLHTMPELAILTDAGQLAYRINAPQMAPREDDLALILNTSGTTGKPKRVGLTHRMLVNAAHYDIMSHALTPDDTAMVVMPMFHINAQVISVLATRLSGGKLVIAPKFSASAFWPTIEDNHVTWVSVVPTIISILLMNQNALKAYHDNIHLRFVRSSSFALPEDKLVAFQSRFHTQVLEGYGMTETASQSTLNPIQAPKIGSAGKPVGTDLRIRLADGTLTKKPFVEGEIVLRGDHVIHDYLEPHPDSFADGWFLTGDIGYLDQDGYLFVKGRRKEMINRGGEKVAPAKVENVLNELDWIAQVAVIGLPDNLYGEAVTAVVIRQDPTADPQQAKADLLDFARQHLAAYECPTEVVFVKAFPVNTTGKVLRPKLRDQLMRGGKLYEA

SEQ ID NO: 8138 - protein, 412 aa, Lactobacillus casei
MKEPVLTATAAKPAKKHRYLYEIDLMRLIFIAGVLLNHTTTAFEHQLSSGFASTALLATHLMIHFTRMGFMFMTGLVLTMVYYSRKRNWPLFFKKRFTTVGIPYVLWNTLLMIGSILLGIGGFTIANFWPDYLSAILHGDQFYLYYVLVTLQLYLLFPAMLWLFKKTEGHHGALALASFGLQLLIVAGIKYGLPHIDTSGWLWWFRAYGVNVFTYQFFFIAGGLFSLHAKAVKDWLLDHQLLIGISTLILSFGTIGLYVFNKQILGMTHSAAVSPHQPYMLVYDVVMIAFVALLGQKYATWHAKQPTHWFACLVGNGAQVSFGVYLCQTIALSLLSGVLGLMHLSNLTLMLLLPLGYLGILGVSFGIAWFCYKVSPFGWLIGRPQSLSLSAKGVLNHEQAHRSVISESHQSS

SEQ ID NO: 8139 - protein, 234 aa, Lactobacillus casei
MTNPIVKLQHVEKVYGDKTVLNDIQLNLYPGEFLALVGMSGGGKSTILRLIAGLEAPTAGHLSREKGLVMRVMFQNDRLLPWLTNLDNVSFKNRDPEVISEAKSLLHAVGLTDKSTGYPAQLSGGQKQRLALARALLAKPQLLLLDEPLGALDALTRQRMQDLILKIFTEQKLSTLLITHDVNEAARMADRIIVVRDGQLVAETTGARGQSPEVVAQTAARVLQAILSEEPVTS

SEQ ID NO: 8140 - protein, 271 aa, Lactobacillus casei
MQEVTTLTQQPKKRTRRSVNWLKVLPWIVPLAVLIGWQAAVSFNWITSSLIPAPTTVIQDGITLWQNGELPKNIAISLYRATAGFAIGGSVGFVLGLINGLVKPIRALLDSPIQMLRNIPHLSLIPLMIILMGIGEPAKIALVAIGVMFPMYINTYQGITGADPELLEMGRAYGLSRRALFTRVIFPGALANILMGVRYALGVMWTTLIVAETISATSGLGYMATNAQEFMRMDTVLLCILIYALLGKLSDVIAKNLERLFLSWRQGGVDA

SEQ ID NO: 8141 - protein, 705 aa, Lactobacillus casei
MKRIVSIFLSFMVLLASLFVINIFQTNDQIRVENIESTSTSFKVYLANTTKSPQATLSFFEQLAKNQHASIVRTDFPNQTVLKSAVVDQSSFPYTNFFQNPQPVKLFEKPNATYTQTASSKGQPHIPVFGKSINIRLQSMAAYFKNGDKSANGIYTIIPATGASKDTITKEFAVFFDVPESELLTPKTQSEKEYVNRDLLMYGVAFGVLALLSLLGVLALAMGRIKPIGVWKIVGLSTRDILLQLYRLPIITTLASSVLVLAACYFNFDYFPKGFWTLLGASQIAVLLIFVIAILIVLVLIRSIKVVQFLKNAISFKLGTGLLAILKAVMIILTTVLLIGSLANIKDIVAATKRYNQVAEVGKKLTINSLGFEGEALKNFELNNGKNEAKLGAVFSQLDTQLSAEFISGGTVYPRRNLTRYPAASTFKPQDAYQVVRVNQNALRSFNLSTKKHLSNQFLAPISRKNDRHIKLLSQLLAYDRLSEAEQKKTTPSQLKVTIQYYTPTTERAKYFSSDGKWHATSNPIFEVINPQKIDYKSQNQLLTADVSNPLRITNTKQNRQKLKAMTNAQKLGGIELRFATIGSILNNETDSSRLGLQISAGLLIITFLISLIVSAFASFLYFETHKFKLSVLRVLGIKLFDRYQQIIGFLLLMYVTQIIVAFMLQKSALAIVVGLILAACDLLVSFAMLYHEENKNIVQVLKGE

SEQ ID NO: 8142 - protein, 215 aa, Lactobacillus casei
MIDLTNVTKTFASKTIFDNLNLHIETGEMVAIMGPSGSGKSTLLNIIGLIDDFSSGTYEFDGVKNIKPNSRQANRTIREKISYIFQNFALIDDETVGQNLAIAQKYLKLNKAQRQTQIDDALQTVGLNGYADRKIFELSGGEQQRVAVARCLIKPSKLILADEPTGSLDGDNRSLILNELKNINRLGKTIIIVTHDPLVAKECSRTIAIGSSSED

SEQ ID NO: 8143 - protein, 104 aa, Lactobacillus casei
MVTIIRVLYKGKPASVWEISQTSERPDWVKDALAKNQIYWLDNRVRILMAALRPPIIKKINFTANDTDAGFGVYAYGYTGDFLDATNQRVVSRRRFLKEYEVLE

SEQ ID NO: 8144 - protein, 222 aa, Lactobacillus casei
MNFIVDPRVLALGVKIRGVELTGVDNHAYPQALKEMIANEIKQVLTTLDREQIKTDPVIQGFWDLHRAVHLPKRNNTPAPATLLKLILKRGELAPINPVVDLYNLISIQSHLALGAHDVDRIDGNVNLRLTTGTEKFIPIGANGQPEPVKAGEYAYIDDSNEIICHLETRQVEKTKVTAETNHLYYIVQGNQQTSQDFVDQTAEQVIALTTKYLGGQGKLLN

SEQ ID NO: 8145 - protein, 59 aa, Lactobacillus casei
MAKAQPFGLEATYTPISKRSCSRSHKKSTHPLLSKGRVLSRGTTQIYITFTSNASTTPQ

SEQ ID NO: 8146 - protein, 178 aa, Lactobacillus casei
VRKLMSLLVLMVTIVGIAGCQSKSSDSSAKKSSTMVTTNKFDQKALQKRYTKISDTVIQTLTKITVKDDQKDIMASAKKGVDDLDKITLELQNNQPASGIGTKNTNGDLTKALITYSQTATDALKSLQGNDSNAFQSDVKNFFSQAASIGKQYFNGQLPVSIQNFSQNRQAVTTIPSK

SEQ ID NO: 8147 - protein, 487 aa, Lactobacillus casei
MVYFLTYRFEGDTPSGKEQVQRLQLFADHQVPASIIVLSAQEDLDEQVQKARLQSDQVMSLIDALRGVDTSEGKPLYTIGDIMKLNDYQTKTVDHHLQFLNGDHLMYDVTAFDDEAELTAQRIHTITFFGANNRKSYAEVYDHQGNKVKTVYFQADGQVRLAVYFYANGMPLLFCQYDGNGILQHLTVLDLAGQSAEFTDWASFARYCLVHVMKQQPGKLLVDQPSRVLPMLGQATMTDFVPVVRTEEDVSAIRQVEQSNVGRAAFGQLIADPQAPFASSLTQYGNVVPIAATVSQQSTIPEIKPWEQRLPDRVAMELDNQNSAIFEQLLSTLAMVKVKENQVKLDLFVKHQDQALAQQLLKRIEPLGLSSLLDVQTQSLADSGDLGQVMAFIVADLGNLGDADLLSSLTYGTPVITFAKTADQMLNGATNGELGIVKPSEQVLDAATDILKLLTDQTWWQEVSNHALAAAKPLQGLTGWELWKMVL

SEQ ID NO: 8148 - protein, 337 aa, Lactobacillus casei
MGWLSNRSKKKQETTNATEKTNDFVISDDKQDFFYLETLPEDMSQQLWAKIATVMNYFKNKGLAPAIIDGGFGFGKVSRFMRYRDKEKLFLPPTSYHNFYTSLHQRGSVSRATATFGSEFTKELTPKQTLGSHVTRYVDQDGQTAIKVERDDQERVQVVSYFRDGKLRREDSYDHQGRLMMTERFAEMPNIHRQNATDPFFVTTSVHRMLVDMSGRPVIVALPTFNQFWVESESGEPIKALDDEEELMVWWLLQNFQHTKRKLYIDADSDLFAQLIDEPAMHPHLVPIVYDKPDTALLANVKAQAYLISQQFVDQPDVKRLAGEVLPILSWHEYMPH

SEQ ID NO: 8149 - protein, 766 aa, Lactobacillus casei
MLQLFSRNRKLNLWGGLKMSIFGKKGRIQFLRNQPNKLQQESEQNSSAATGDSYTDLFSSASSVKSKQEAASKPRVLPETGTKTAVADRPVANLRSATASTATTTTAKSTSSSLTESASASTSNTHTGSQSSSTASRTSVATSAKSTMSAKSPEASKPAMAKPTQSERKSGEVPSSAPKTEATNITASSAKIDNAKNTLKQAISTYNEARRTLQTNMFAKRADLQAALTQNKLTLAQTQRDIKAMQKRMAQNDGSELVPAQNTISDLQNQANKIASQLKSKQGILDDLNRQRRSLEKQAQMTLEQGKKFKQDEEAIMAAFSGIKDPEKVLAFADAHRKQIDDIKAGEKKLTATQLSLKKQLEDIINEINQAKDEITKINSEQNANGQAITNAQRKLDTLKAKVASDQADDKAQLDKLEHQQADLTDESKRLHDQLHTLSDGITAWLNFSEPVHALGEADYAPLILDIDSFSAHDFEALAPLSDMLQSMPKKQVGIFTTYFNIDLVPTIDAWSTANNFNPDEIQIINCLYQLQNAGEGAENAATLPANIKNRQWNENHTAETITMPDGQTNMLVTYQLDAQKKPTKLIAKIAYRQGDKLTKESFFRKNGVLSANTFYDVANGITRKEFYRRDGLLVVSATYEGQKLSDISVFNEAGLQINSFDSLTALNVWWLQKSFPQEGAMIGNFKSKAYRDLTAKSGVKLVPFVDEAVVDTDDFTRWMADHKQQAFITNNVTTQSALAKKAKLPLYVNVLNQAPLPVQLSMPAD

SEQ ID NO: 8150 - protein, 472 aa, Lactobacillus casei
MGLFAKKKTSDQNDLLGALEKQLRRAGDDGLAGLAELLPRTDANGLQTGIAGTATASESEPSGNAEQAQADDVPEKSEVVKSKNWTMSISKGAQLSFANDQLTLYVDSEQSASSQSASAADANDSADLKVTANEKEKKEGEASTPAAGMAFKPDNVIDIDHFNHKSLSEADAQASDAAAIASAGDTRTEIAATASSDPAKTTQQLQDGENGSTPEMNVAKSASQAAVEKVIEVSSEKNEELSSTANSTHSQAPTEGNAGASVPNQQMTQVSENQSSVEHVTTEKPKVSDQTSDSTEVHSATGRSSETETAVMVAIKALQQQSQMNQEQVAALSTKLAQHLDASAEFERTHSKTVNKLSEILINLIVTKNELENTKKDLNDTNEALGKIREQVRQTHEEVLNRQNVQNESQHALVTELQAKLQEAQKSIKALTDKYAESQEQTKTLQDKVNNLRFENLQLQHQIEDSKMIQAE

SEQ ID NO: 8151 - protein, 896 aa, Lactobacillus casei
MGNHSGQRWLNQQTKITRFRRWKSGKKWLYASSVIVTFASGAFLADAVMTNHVNADTQSDIETAIKVTDQVQKTAIQADNLQNSEVPRDKNAGFQVTREQNNQPTVDNQEKATVSPQQETQQVSTTKEASQASASVSQQKNETVATTTEEPVVHLAFTTSENDPSRSAQNVSQPAATAELTKNDKYTEKGSSVSAELQSIAESETKTSSSFTEGSTSITSNVTSDEVEKNQEARIRQAINASLHIDQYVSSINQSQDEAKLEEITSSAAANRASAIILGATSTSAAQPWLTAPDLSQLVKQISDVYNLTLGDAVKWAIKNGVNGALDGLSAIVSGLRSVAGSLPIVNVILPLASGAIKAAQDAVTVANSLGIDPTGLVSGALNLGINTIGKAIQGVISPVLKSIPFIGQNLANSINPLLDTATNLGPASIVKAVAGVVGLSGVLTGVSNITATVAPTIINALQGVLNISVSVVNGIASFAGSAMTMFKDVLGGIMAPIQWVINQVKTTIQGLFPGSSSTGAATNNNNGKDHQNGDSKTPAPKTPDVTDSDSTDTSKSTTLTPYINLFDMSIPLGTRWNPTKMLIAAVNSTGKAVSLSDIRIDGTVPVTLPGIYFQRFEFTDPNGTIVTKMGKVRVGGKESYTIPSDSATLASIKNAIQSLPHSDSNLASRFTSTTNYPSKEAVYLAADPDFKPDAKEIAAEFLQYVNQLRTLNGQKPLTYSVSEEAFATKRVQEIMTNFSHDGSHGSTEDIGASKGIIEDMHSNQEIAYYLVMDWYDESDNPEPIGDGHYGHRANLLYGGPTMGLAFTQSPSEKNQYSYYYAFEAPTYSDKSLYDKALAMANAKTNPQTVPLPDITFVYVDSPEFASLQAQLKQLQAEQKVIAPNADSAIKTVAVA

SEQ ID NO: 8152 - protein, 81 aa, Lactobacillus casei
MQEELKLKPISLPVGLRFDPSDVVVNATYSDGANVPSAKLEYEGQVWPTNPGFYPVKVAFYDEVSGKRVEEKTIVTVHEVE

SEQ ID NO: 8153 - protein, 803 aa, Lactobacillus casei
MKKNLQRQRGNEKAQIKNTHFRSWKKGKKWLFASSLVVSIIGAGALESGKTVKADVTTDTIQVAQQVDQAAASAKAASSAAVQSEASAETTKNVEQPSASSVATETAKVVESSAAAPVATSTQAPSAAASQATVATAATPAPANSGAATTTNAVSSAAAVAATKAGMDFAASIGATTASSGTPTSQQFADLLSSAASYAKTPAGSAAFAQLGDKLQSAASLLSEAGSLANDPAVLAFKKQLSDAAADPAKQRALIAEFNTTSQGKALNSLAAVKASLESLASTPEAKAMLNSLSSSISAASANATKKAAANSAAVAEFMKTDAGKKLLDEAKLAADSGAAQSSAAVTAYLQTADGKALLETLKSYADIPEFAAFSKAMTAAEKASDATAIQSLAASFFATDIGKAFADDLQKYEAKDSYKAMTKQINDAQDAVANELKSSISKASMSTSLAGFDLGGIVSGITGTIWNVVSWLATNINPVRLVPDLTGLGEIGKFVESLVGGAIGSTFYGTIATGVGGFGAFLVAGIPGTILNSILGLIPIVGIVANASTAGDIGWAPGITGWLAGLIGAPLGAYYGATSGPGLADKDGNLDTVVSGTALGSAIGALVGETLGDWIISFPIGTLVDGIAGFIGGVIGVIGLGIIVDPIMFLVVGWVTALTDTIATLVGTPIGSVIGGAIGGGIGAVASLLGLKLQLPNLQLLIKDVGSLPGISDLINTVQSLASKAGKLKTKDIKLFRGARFNPFDAIVSAQDGNGKDISKSNIKVEGNIYTNLPGKFYVKYSFVNEMNDNEVVTGYATVTVA

SEQ ID NO: 8154 - protein, 2686 aa, Lactobacillus casei
LPLNHRFMRHRFHIFNQECGQWCPNFLIKWGEQMEKFNKKQKLVKKNTNFKMYKAGKRWVFAYSILAFLAGGAGVAISESAPVHADSNVEQSIAAAAALSNTSTPTSSVAQQSAASSAQSRAPQSAVAQQSQANDAAIQASVQVASQAQAAAPSSAAATNVQTQSTASQVQTATTPASATASSAAASSATANPAAASSVTLASGSVASDSGDFPKSLTMDQNGDKSVLMTANNLTIHAGDAAFKSAFPDNAVASAATQGQQLVTFELGNGVMLSASLAEGVIDYSQTTDVGDGQFHGPFAAITPLPKISTELAKQVGRPETDANIPVWNSVEDYNKPGTYAVVYTVQAAQATGATEFVGAFTGYFFIRVIPAADTTKPTSDASTASTSASQATVTANSAADIANTASTAASSAYAYTSGAASRHPDNKDLADLNSVASAANTKTAGFASAAASDAAGAKGLATSVADANKAVESAVAQVDAANKAGDYDAAGSYANEAAKAASNASSLAAKANEQAAKALQEAKDASDAAKVATDAMDKAKTIGAAADAKDFASDAKKSADAASDSASQASTDAKKYPSDTLISNAASTASSAAAKASDAATQASDAAKNGNESAASNAASDAASDAKIASDAAVTAHSQANANEARGYADNAKASANQASASASQADDFAKKYPSDAKVSAAAAKADAAAKVASDAAKAADEAASKTDPHTAFSQAAIASQAAATASDAAAEAAKAASAASDANSSAAVTDAGKFADAAKKSADAAATSAKQAGSTKDKYPSDPLIVHAADTASSAAAKASDAATAAATAAKNGNVSGASDAANQAAGFAKDASDAASLATSEANVVRAKELAGQAKNSADQAAASATKAEGYAKQYPSDAAISKATSTATSAAAVASTAASDAANAAKSGDVPTALEKAYEAANAAQVASAAASDAAKAAAAYGDGGNDSGGSTSNSQAGIYADAARKAANAASDSAKQAEANHNKYPSDSTVSTAASTASSAAADAAKAADAASDAAKTGDVAKASNAASTAESDARIASDAANRAAKAAEAASQAASKAASDAAKAAANDAAKASDAAKKAASDAANNKSDANIQSDADKANAAANQASTAAAKASDAASKGDSATASKAATDASNAAKTAGEAANDAASRAANNAAKAAADDAAKASDAAKKAASDAANNPSDANIQSDADKANAAASQASTAAAKASDAASKGDSSTAGKAANDALNAAKTANEAASDAASRAANNAAKAAADDAAKASDAAKKAASDAANNPSDANIQSDADKANAAASQASTAAAKASDAASKGDSSTASKAATDASNAAKAATDAASDAASRAASNAAKAAADDAAKASDAAASAASNAFDNPSDANIQNDANNASAAASTASSAAAKASDAARNGDSSTAAKAATDASNAANAAVKAASDAASRAANNAASDAHKSADAASDSASQASDFANNYPDNAAVSNAAKKAADAATDAANAAKDADSAAKNHDAASASEAAKRAANAAAKAANAANDAAKAAQRASEAASQAATEYADDAHSSANDAAAAASQASDYANKYPDDAAVSTAYKKASDAATDAAKAAQAADKAAKSGNVSDASDAASRAADDALKASNAANDAAKAGAKASEAALNAAKGYADNAHSSANDASDSATQANDYASKYPDDSAVSNAAKKASDAAADAAKAAQAADTAAKSGNVAEASDAASRAAADAVKASNAASDAAKAAAKASEAALNAAKGYADNAHSSANDASDSATQANDYASKYPDDSAVSNAAKKASDAAADAAKAAQAADTAAKSGNVAEASDAASRAADDALKASNAANDAAKAAAKASEAVSNAAKGYATDAHSSADKAADSAKQAANYANEYPQDSDVSTAYKKASDAATDAAKAAQDADVAAKSGNVADASNAASRAADDAVRASNAANDAAKAAAKASQAALNAAKDYAANAHSFANQASDSANQTSDYANKYPDNAVIADALKHASAAAADAAKAAQAADTAAKTGDVSAASNAASRAEADAVKAANAAKDAAKAASSAGDSGTSTAANDYADAASKSAKNAADSAKQTGSYANEYPNDKTIADANKTASDAAADAAKAAQDADTAAKTGDVSAASNAASRAEADAVKAANAAKDAAKAASSAGNSGTSTAANGSADAANKSAKDAADSAKQTGSYANEYPNDKTIADANKTASDAASHAADAAKTAEQAAKAGDASKASDAANVAASDAKTASDAAQTAAQEAANNAAKAAANDAAKASDAAKNAANDAKNNPSDAAINSDAAKASDAASNAADAATKASDAASKGDASAASQAANDAAKAANAAASAANDAATKAATNAVAGQDYVSAATNAAEAAKKSAALASDAAASTAAIAKNDPNNKQIAYLNTDASTASSNAASYATDAATNANSAKIAQSLAGVFKEAGKADEAAKYTAAAKRYADAAIADANNAANAASRAEADRDLAKDLATQANNGALPDTNGNGSGTNSGGNNANGNGNGTNGSGTNSNGSNGSGDNGQGTGTNGTGTGADANHNGGNGSTSGNGSNGNGNNGQGTGTNGTGTGADANHNGSNGTNNGNGSNSNGNNSQGTGLNGNGTNGSGSTTGANSVGKLSATGVTNGSTANNGNQFGNGSTSGDHSLPQTGEDEATGAIALAGVSLMAALSLYGATRHRRHEA

SEQ ID NO: 8155 - protein, 518 aa, Lactobacillus casei
MYYFLNENMQFAKSGIEGAEIQRLNLFNQHQVPAKIVTRVFAMNLHDVTTDAKISDDHFVNLFDYFCGTTHVEKTVTTVDDVIAVGDDITQKAEDNKITYLKDNKLYRIAYLRQGAVNPREISNVQYFDTTGRTTKMSWWNSRGFLCLNQYFDNAGNIFQEHYLDLEGNVKIEKLHYLNRANKEKFSYKLDDFDGVDYLFDGLHDLTRFFYDQLNKVDGGYNVFISDRTTETGWGLRHMETAAFKVLHLHNNHLADDKDIMHDRLNNFYASSLNNLDKWDGIIAPSSQQKKDVEARWGTKPPVFNIRVAFVKAADVEANKVPFAQRENNLVVHVARLAPEKQQDSSIKAFEKVLKVIPDAKLELWGYANGDVGDKMRALVREMHLEDSVLFKGYTSNIAEVYNRAQVGLLPSRAEGFPLTLIEAQSHGLPMIANNIHYGPADILEDGKSGILTKNGDIDGLADAIIDLLTHKDKLAAFSEEAYQNALRFTDDNTFEQWQTLFDYAAKKRAKVLAAEAL

SEQ ID NO: 8156 - protein, 505 aa, Lactobacillus casei
MIFFLDEYLLQKNSSVEHAAAKRLALFKRFNQPAVILTRNFDRLSVRTLGKMKIAQTDVLNMFDYFQHIPSDMPEKTVLNDEMNLPTLDEVSVDANQSQVTDGDRLRRQVGYIPETFGHVFYQNYLDDQGNEVERDLWDARGFRSATQYFGRDGLLTFERYYDLDGKPVIETYYAGNQADQMQLTRVVLKGKTILDNREFDDLDGLFTYFLDELADADPGETIFISDRPGVGVLPLRNMQQAAKKFIYIPINHVVNNGNPQTDPVDGYLKPAFADPAKIDGFIVQTPSQRDAIVKRFPAAKVTAIPAVTVDPKALPQKPTEATTAVDNKKLMYVGRIAEERQLDQMIRALGLVNNKIPGVELDLYGYGDADYQKKLEALAKDLKLDKQVHFKDYVTDLDKRYEQYAMLLNTAATDGGPLAILEAQTHGLPVISYRFHYGPSDEIANKEDGYLVPQNDLAIMAKLIVDLLQHPEKRAAFGEKALENVGRRLDEADVYKQWQQVLGL

SEQ ID NO: 8157 - protein, 335 aa, Lactobacillus casei
MIHYGLIGTNQATDDFVQAASVTNKWELGALYASDVDQADQYAQKYGTNQTFFDIADFFKNGNFDTVFIASPNGDHFSHIKQAIQADKHVIVQPPALTNPTEFAEVEQLLTDHPRALFFEGAYPIHMPNFKNIEAAVGKMTMIQGATLVSMREQPEYDAILEGAQPEGFTLASFGGALQQKGVYAIYVALKLFGRPTSATYFATAVETGVDGTGVAFLQYDHFYVTLHFGFTTDSYMPTEVNGHHELIQVDDLTEMHLVQHYDAQKKVTPLMSADYMYHFTGELLAFTEVLEHPYTSENRKKYREWLQLAEDVNNVVYHLRQMVGIKFPTDTPQK

SEQ ID NO: 8158 - protein, 396 aa, Lactobacillus casei
MKAYSSPWFWWYFVQGLILTAGYLLAAQGAQFWLWALVLTIIEGGLLLVSAISAPKHWISRLFKLLAVLIQLIVYPLIVFYSGQQFLRVLPGNLSLILITVLILLAHVPFAKVLFTPDQHYLTRVITTLVVAFMVIYAGTTFTEGLTKSAFASPLWSFAEAGVLAAIVSVLVGAIAMRQWGLPLPSWRFNPNMQAGVLIVLVVFIIYFTLWNAFSTNDSFQSLFIWSWHSNPLTFNWFAQGLEPGIAEEWEYRYMVLTLLLVWLGRHRLALSGSIFISGLLFGASHLINVLGEQNWFDTLSQIQFAVVFGWFIAAVYLYVGSFSIPMLVHAAVDILSMVVSNTEASITGSITVYLFQTIVEVVMIGLTVWLLTGRRRQTMQWTLDRIMPKQSSLAI

SEQ ID NO: 8159 - protein, 158 aa, Lactobacillus casei
MSDVKYPQTIDQLNQLIADLMQLQTNVQQIHWYMRGHNFFRLHPLMDDYKDQLAEALDAIAERLIALGGSPYATTHEFIEHTGLPDEKVAFGQYTLVELMQRLVKQFKYLADQYQKAIEITDQERDFPTQDMINGYKEETDKNIWMLNAYLGKGPLDD

SEQ ID NO: 8160 - protein, 399 aa, Lactobacillus casei
LKKWSWVTIGTLVSVAVLGIGGWWLIDHYHYQQLVDQPADVKKWQADPRPLQSESEAQKRITEIRQPSSGVHLAKKTKMAVIPGLRGAWSIDNKTRQAAFGTNWVPQGVTQSKKALYVSMYDGDHRLNSIIIEIDAKTGRYNKTLILRSKAHVGGITYDLDKQRLLWSDDNSKAGGAGISYAAQREIDAYQPQVNQAPLASTRIPFHLANRTSAMTLYNHQLVLVKYGKKTTGRSLIALPLNDENLPNAITQKQFDKIVTDLAPQTQHKSTTQMLDILFKTLIKKKIINSYNPAWDRLQGVAIAKDGVTLFSQSNGSAPGKIWIRMAVNKGWEKLDFKSPKAGDKMINVPNSVEEISFNPNQNELLLIFESGAKAYREEGWFFHRPHYMDRIMYLPLTV

SEQ ID NO: 8161 - protein, 245 aa, Lactobacillus casei
MDKAINEEHECFVKRLAAEALVSDGVQLPLREIIAILPLPANFLSGKMLALTATANYLLPNTSLSFVRYHEDESIYSQSVHQVIVTKLYHGNAEKLPKMLAGPGYAFIPLSAPDHRSVIWVASHHLVDHAIQRRGGKQIITVKFCGNMKMTLPTTYHAAHFSEILAGSRLLMDVTEQLARISAGHAPLADDPQHEHTVLVDHQTAKILMHHVNGRLWQQGAKQAVGEDRYMLQSVKEKGRNPDGV

SEQ ID NO: 8162 - protein, 272 aa, Lactobacillus casei
MIKLIATDMDGTFLRNDMSYDRNWFDRLYHQLQAHHIYWVIASGNQYFQLRSFFEDYPETIFVAENGAYIRDANHIYALNAFAPSIIHPILTHLEQIPDLKVSVSGQAGAYTLDTMDPNHLAIMRKYYPKLTLLHDYHELDDKILKFSIGCPPERTDAIVAELRSALAGVATPTSSGHGDIDLIRPNVNKAQGLALLGQKLGIDLSEMCAFGDGGNDLEMLQEVGLGVAMANADPRVTAVADATTTSNEEQGVLKFMETLITTDQRHAVKGR

SEQ ID NO: 8163 - protein, 604 aa, Lactobacillus casei
MLSKLALGGLKNRFRDYAVLFSGLVIASAVFYMFMALATNTSFLKQNSPISYTPFIFGFGAVLLAIITFVYIVYANSFLLSMRQRDYAMFMMLGAKGRKIGQLIFLETVAIGIFATFAGVLIGLVGTNFIGKWLINALHAQATGFSAIWVPAILWTFGFFVVLFILSAIYNTAKLLKMPMMRLLRQAQTPNRVKQKKIFFALQIVLGLILLAVGYYCMGNATHIGIKAIPTALVTIVMGTYFLFNAVFVALIALLKRNHSFASKQLHTFTLSQLSFRIRDYTRILSVVSILVALALGAITVGLGFTHDIPVLASQYTAYDLTVVSPNAQTQAEIKKLQGVTEKQQYTLKSDAKTVYISQRALDAHPLKVQIRDQSRNGKLRSVTLTSRNFNKIATQYSGAIGIFIGDNRGKQMRVADDATFAKLGNAETLTTFRVKNFNQNYDTIEKIINLQNKQYPKLWGSDTDQKFESYSILNGMYSGLAFMGFFLGLSFLAMLASTLMFKILSGANYDKRRYLMLQKIGARPQVLRRSIRQEIGVLFLLPGIVGMIHVLFGLQLFKMILQAPYDNLIVPFGVFIVLYGLYYLITTWMYQSIVINKDLATKG

SEQ ID NO: 8164 - protein, 252 aa, Lactobacillus casei
MDKQPVVTVENVTKTYGKRGEKQTPALKGVSFQVEPGEFVGIMGASGSGKTTLLNILSTLDRPTSGAVRIKGEDVTKLKGNALSDFRAKKIGFIFQDFNLLENLTGRENIALPLALQNVSAKKQQAAVDQIAATLGIAAVLDHYPTELSGGQKQRVAAARALVQQPDILFGDEPTGALDSKAARELLDTMDDLNKNHGVSILLVTHDPFSASYASRILFIKDGQIGSELVHGDKSQEAFYQEILETLGTFQK

SEQ ID NO: 8165 - protein, 103 aa, Lactobacillus casei
MVLGFGAMKAYQHFSYGGPSYYTKITEKGKESNDSEGNKQYDYKLTGYDEKGQAKQLKFKVYRDRPLKMNAYLKMTYNKNRGVTRWQSVPSKDVPKAAREKLN

SEQ ID NO: 8166 - protein, 105 aa, Lactobacillus casei
LNHDTFKEYVMSHCHAVRDFRRRAVVYQRLKHAQGCAADQRDPVIEEKAVEAMVERFVCSAYCNLKRYIKEEDQDSRQAWIAFIEQQDVLASLEASASQIVLHDE

SEQ ID NO: 8167 - protein, 426 aa, Lactobacillus casei
MLIEFSVQNATSIKDEMILSAETGERLSRLKETNTIRENNSSLLKNLIIIGPNGSGKTNIINALKLMRSMVLNDPDKITTSLPYNPFRLNPLNAKTPTKFQVKFNYGNQTFQYSFSYVSKAIVAEKLTQVLKTTERTIFAREGQNYPVLDEELKKVAANTKKNSLFLFNAQKANISAAITVLEWFQKDLVFVNSKNIIPDQLTELMDDKRIKNEFLRFLRFADFNIVDVKVRDIPLSLPEEIKKIMATLQPEIDLPDTRKELYASHKQYDDNGNVIGTEEIPLTQESRGTQKIFLIALSIINAHLNGNGKTILFDEFDDSLHFELSKALIEIFNSKQNRNQFILTTHELQLLNSELRTDQIYLVEKDFQGRSSLYSVFDFKDSKNTARHDVQYMKRYIEGRFGSLPQIDVDEMLSALNASNPPARK

SEQ ID NO: 8168 - protein, 204 aa, Lactobacillus casei
MMPRKSRKIPYKKIIAIYCEGESEKAYFKMLKRKYHAANVHVRSPKLVITSVGLSGMSLLKKAFQKVQRLKSNEQAEKVYVVFDRDSLGPSEIADCRRFAKQHKMSIIFSNVNLEVWILMHFQSVRRPYTPTELNSILSGPAFFNTNYDRFKGKPYDDLLYDKVKTAKMNADALENGYSEPLFLNDPFTNMNHAIQEIFDVTEF

SEQ ID NO: 8169 - protein, 88 aa, Lactobacillus casei
MFTLLLGLLLAFNGCVFITVFLKLRENDARETLEDSPSNIILFVLLAGKVAKRLGVNDPYRRASLVGGIVLVPTSLVLIVIGLGEVMA

SEQ ID NO: 8170 - protein, 92 aa, Lactobacillus casei
MTIKKGVYLIKTLSGSVYKLVNTDNQKWLERVPSQESSSLRRDNERIIVYEVLNLAVGKPALFAIEPLGLGNVTLRETTTVLEMIVVDQAEC

SEQ ID NO: 8171 - protein, 130 aa, Lactobacillus casei
VAQVQYAGTGRRKNSVARVRLVPGTGKITMNGKDVRDYLPYENLITDLTQPFGITETTGSYDVLVNVNGGGFSGQAGATRHGIARALLTVDPDFRGPLKKAGMLTRDPRMKERKKYGLKKARKASQFSKR

SEQ ID NO: 8172 - protein, 148 aa, Lactobacillus casei
VRTTFLAKPGEIERKWYVIDATDIALGRLSSVVASILRGKNKPQFTPNVDTGDNVIVINASKLKLTGKKASDKIYYRHSQHPGGLKHEIAGDLLRDNPARLVEYSVKKMLPTKNTLGHQQFLKLHVYAGEEHPHLAQKPEVLDISNLI

SEQ ID NO: 8173 - protein, 456 aa, Lactobacillus casei
MSQKENQFVTATDFTRRFKHFKRWIAVPLIVFICLLVLFMALTKQEKTIQANGTMATSQRGRALYVQGPATITQVMMQFGQRVRKNQPILVYRVTADTDRIDDLASQITDLKKQQKQLQMFGQSVDQNKNLFSEADQYGYQQAVQTYLNQRQMVTQTLSGNAAASDNQALTNKRQEVDQLLTTMIAQTATEIGQIQVAEAAIRGQGSVAADNPYAGFYQHYQQAVATADAAGKAAIQTQDLAQLQGRLNDRQKQLAALQAQQQENQQTTGTGQASAETLLTTLQTITEQTLAADAKRIQQTLGKLEAKDNDLRHAGQPQTIKAPVTGLIYFRQSAVADQQIVAKRQVIGRILPEQNHQSSISFTLKVAKKDVSSVKCGQQVRVKVEPNAGDTLILTGKVTQIPSTNQLQQGALQITVQSRVSQSQLARLHDGITAQASIVTGSQSSWQALVRNRGI

SEQ ID NO: 8174 - protein, 725 aa, Lactobacillus casei
MRVTGNFWVRHVNRCDYVPQADPRESGVAALNMVLKFYGAEISPTRLRALAEVDQTGTTLDDLIHAAEALHFTTKSVISLTPKRLNETPLIVASRDAQAGQQRFAVVFKITKRHLLVADPDVTVGVKWLSYQQFNQTWAAAGAIIKPRLNHTAVKMPSSHLRTIKALILQQKVALVYLILAVLATTGISVAGAFFLQIIVDTYLPNGLMRPLAIMALALMGAGLFEAVLTWGRELLLGMLDQRLMIDVTLAYVRRLYAMPLPFFNRQRQALTAQVAETNRLIGVAAKTLATQWLETLAATILLVLLVVMNWKLALPAVLAIFGDALLMWLFRDRLRAAGYATSQSGVAVSTEITEGLRGVEAMQALRAEPDLFRRVDQAFADDLHKKFAQLQFVQLQRAVQRAFHFILTVDLLWLGASMVVTQQLSLGQLVAFAALFVYFIGHLTQVVRLQPQRQLIAVADSRLRDLPSSSAADQQRRVSDSQQISGTIKLSQVTFGYRQKRSVLQKINLTIMPNHNMAIVGASGAGKTTLARLIDGLWPLDAGSGTITFNQTNINDIRLSLLRQYVAYVPERPVIFSGSILDNLRLGNRFDVTDDDMDAACETAEIADDITNLPNLVYTLVDANTETMTASQKQRLAIARALLSPAKVLIFDGTFSQIENATAERILDRLFAIKDRTIILMTQQPQLARNADKIVVLVNGRIVEQGSYPILFAKHGYYAQMLRR

SEQ ID NO: 8175 - protein, 199 aa, Lactobacillus casei
MNQREQQKKATIARILAAAQTLFMTNGYASVTTRMIAEASNVQQPLLYHYFGTKEKLYLAVVMQVSDSMAAKIASAQTGSGSLAAKVNHLGHVLTDDNDMNLQMVIHDIASLKASARGQVFKAWQDSLLAPLDRFFADFQSELLEVYQPREVTLYFLNILAVYLRPSNTAENGGFQQQLPLDRALQMFCTGVSQTDEQK

SEQ ID NO: 8176 - protein, 353 aa, Lactobacillus casei
MFLAIKEILHNKARYLLVVVTFVLIAYLVFFLTGLATGLARNNRTAIDALPGDYVLMSKYANKNLLSSSLTKQQVDKVANKHTAVLGQVSVVAENTSTDKKVNSNVFGINLAGKLKPTVTSGRMPRNNHEVLADDSVTNEGLHKGDRITLNGSDQKYRIVGFTHDRRFYTVPVFYTTLTTFRQLKYGQANAANVSIVISSRPFKTIPAKTQQIDRATLINNIPGYTAETSTFALMIGAMIGITLLIIGIFMYILTIQKISMYGVMRAQGIRTRSIIAALFWQILILAVVGVGIGAGLLGLTQFILPKTMPFYANPALFSSIAAALIVMSLVGGLFSLRRIIKVDPLAAIGGGE

SEQ ID NO: 8177 - protein, 236 aa, Lactobacillus casei
MTNLVELTQVTKIYGSGRTAVTALQPTDFVLKAGEFAAIIGPSGSGKTTLLTIIGNLQRPSGGKVIINHQDTTHFTEHQRTELRFNTFGFILQASNLIPFLTVKDQLALVDRFNHHKQHKMSKSELFDMLGITDLADNYPAALSGGERQRVAIARALYNDPPLVLADEPTASLDTKRALQVVQQLADIAHNTDRGVIMITHDTRLLDPVDTVYEMRDGHLRALPKSSLEKIQETAI

SEQ ID NO: 8178 - protein, 73 aa, Lactobacillus casei
MASVDPEKTLFLDEPMNKVFDWSDSEAPVRDALWDYYMEKNSRDTIKTEEEMKPVLDMSDDEVKALAEKLLKK

SEQ ID NO: 8179 - protein, 142 aa, Lactobacillus casei
MTDDEKFAAFKNRAINDNEQTFGKEVREQYGEDIVNASNEKFRKMSQAQVAQLTALQQKILDELKPLVGTNDFNTPEAKHLFKLHKQFLQLTWPSKQYSPKAHRSLAALYVSDPRFSKYYEDGTGKNGAAETLNAIIRHYTR

SEQ ID NO: 8180 - protein, 247 aa, Lactobacillus casei
LTHYKVTLAYDGTNFAGYQVQPKQRTVQGVLQKALTKMTKGQPVHVDGSGRTDSGVHALGQVISFDYPGNIPAKSMLRAMNSLMPLDIEILKAEIVAADFHARYSAKGKRYMYRVARGYYTNPFNRLYTGHYPYKLDVARIEVALKDLVGTHDFTSFAASGGVIKDKVRTIYEATVREDTATNELIFEFYGNGFLYNMVRILVATALEIGNGRREVHDFQRLFEVRDRQQARGTAPASGLYLKEVYY

SEQ ID NO: 8181 - protein, 265 aa, Lactobacillus casei
VDKLLLGRYIPGHSWIHELDPRTKLMASFYYIGIVFLANNWQTYLMMFVATLFMIWLSGIRIGFFLRGVRPLIWLILFTVALQVLFVRGGTVYWHWGWLWITKLGLINGAFIFVRFVLIIFMSTLLTLTTQPLSLADAVESLLKPLRVIRVPVTELALVLQIALRFVPTLMDQTTKIMNAQRARGVDFGEGNIFQQMKAVVPLLIPLFVSSFTTADELATAMEARGYQGGDDRTKYRILRYHQRDWIAAGGMAVLTGLLLLLRAY

SEQ ID NO: 8182 - protein, 281 aa, Lactobacillus casei
VSFTYQAGTPFAGDGIKDVSGTIHDGSYTAIIGHTGSGKSTILQHLNALLKPTSGTVTIGDKVITNETNNKNLKPLRQKVGMVFQFAENQLFEQTVAKDIAFGPQNFGVSEQDALALADKMLAMVGLPHDVLEKSPFDLSGGQMRRVAIAGVLAMQPEVLVLDEPTAGLDPAGRHEMMTMFERLHREQGQTIVLVTHQMDDVADYADTVWVMAKGRLIKTGTPREIFSDPEWLKANQLGLPKTAQMAQQLTAKGFHFDPQPLTETELADQLLPQIGGGQRG

SEQ ID NO: 8183 - protein, 278 aa, Lactobacillus casei
VGNVIRVQHLNYTYPEAKHQALTDVSFDVAKGEWLAIIGHNGSGKSTLAKNLNGLLAPESGTVEVAGMTLSEETVWDIRAKVGIVFQNPDNQFVGATVADDVAFGLENRGVPRDEMVKRVDESLKRVGMTAFADREPARLSGGQKQRVAIAGIIAQRPEIIILDESTSMLDPAGRQEVLGVIRELKDELNLTVLSITHDIDEAAVAHRIILLNDGKINEIGTPSDIFAHGTDLLRLGLDVPYSEKLKDALIQRGVAMPKAYLDNERLVDYLWTLHSTM

SEQ ID NO: 8184 - protein, 223 aa, Lactobacillus casei
MHNWLKERTPWQIGLLVVGCWLILSLTFVTLLISVTPTAGITGGPFVPSVYRAANGDVTVTWLAEVWIFAIVCGYLTGRQYRKRQQSPRLIKTLIPLFSMWLILIALTQWHPLATQTFPKSTAGFFLVVMLSFLCIFPAGIMSAYIGLFRKGSRWIWAVFFIFLMQMQRPYLWIVNGKSHVGMTLMHGDPVKWEAWILTILGLIFVAFFAFMSTDPEIVKKEF

SEQ ID NO: 8185 - protein, 126 aa, Lactobacillus casei
MSYRKLGRTSSQRKAMLRDLTTDLLINERIVTTEARAKEVRSTAEKMITLGKRGDLHARRQAAAYVRNEIASVEEQEDSVIVKSALQKLFSDLAPKYADRNGGYTRILKTAPRRGDGAPMVIIELV

SEQ ID NO: 8186 - protein, 312 aa, Lactobacillus casei
MIEFEKPNITKVDESTNYGKFVVEPLERGYGTTLGNSLRRILLSSLPGAAVSSIQIDGVLHEFSTIDGVLEDVTQIILNIKKLALKMNTDEDKNIEIDVNGPAKVTAADIVTDPDVEVLNPEQYICTVADGGHFHVRMTVKKGRGYVAADQNKSDDMPIGVLPIDSIFTPISRVNYQVESTRVGRRNDFDKLTLDVWTNGSISPREAISLAAKILTEHLDIFVNLTDEAKNAEIMVEKEETHKEKMLEMTIEELDLSVRSYNCLKRAGINTVQELTNKTEADMMKVRNLGRKSLEEVKNKLADLGLGLRKED

SEQ ID NO: 8187 - protein, 129 aa, Lactobacillus casei; identical to SEQ ID NO: 1543

SEQ ID NO: 8188 - protein, 121 aa, Lactobacillus casei
MARIAGVDLPRGKQIVIALTYIYGVGKTTAQKVLKTAGVPEDVRQDDLTPEQEDKIRAALDSYKVEGDLRREVNLNIKRLMEIGSYRGIRHRRGLPVRGQNTKNNARTRKGKKASMAGKKK

SEQ ID NO: 8189 - protein, 38 aa, Lactobacillus casei; identical to SEQ ID NO: 1541

SEQ ID NO: 8190 - protein, 72 aa, Lactobacillus casei; identical to SEQ ID NO: 1540

SEQ ID NO: 8191 - protein, 218 aa, Lactobacillus casei
VNLILMGLPGAGKGTQAERIEDTYPIAHISTGDMFRAAMAAGTALGKEAKGFIDKGQLVPDSVTNGIVKERLAESDTDAGYMLDGFPRTIQQAEALETITADLKKPLDAVINIDVAPAKLVDRLSGRFICKTCGATYHKIYNPPKVAGTCDRCGGHEFFQREDDKPATVKNRLKVNIEMNTPLLDFYKKKGLLHTVNGDQDIDKVFADIKAILATVAK

SEQ ID NO: 8192 - protein, 441 aa, Lactobacillus casei
MLRTLKNALKVKDIRNKILFTLAVLLVYRLGTLIAVPGVNAKALQSIGSTGLISLLDTVSGGGLAQYSIFSMGVSPYITAQIVVQLLQMDIVPKFVEWSKQGEVGRRKLNQVTRYLTIIFGFFQAIGITAGFQTLSSMGLVKNPSVSTYITIGIILTGGTMLLTWMGEQITDKGLGNGVSLLIFSGIVARLPSGLQELYRDNVQVYSGAEIWKGIAFLAALAVIVIIVITFVTWVQQANYKIPIQYTRRVTSAGSNSYLPLKVNVAGVIPVIFASSFIVTPQTILMAFQKSHGSDGWYQVMTNIFNMQKPAGTAIYTILIILFTFFYAFVQVNPEKVAENLTKQGSYIPGVWPGKETENYISRLLMRLSTVGALFLGLVALLPQLAANIWGLPQSIGLGGTSLLIVVMTAIELVRQLDGLLMKREYVGFIRGDLVKDDQKK

SEQ ID NO: 8193 - protein, 146 aa, Lactobacillus casei
MQLHELKPSVGSRHARKRLGRGTSSGQGKTAGKGTKGQLARQGGKTRLGFEGGQMPLFRRMPKRGFNNINRKEYAIVNLSDLNRFDDGAEVTPAALIDAGIVKNEKNGVKLLADGKLEKKLTIKVAKASTAAKAAVEAAGGSIEVI

SEQ ID NO: 8194 - protein, 61 aa, Lactobacillus casei
MAQLKITLTRSAAHRLPKQRKIVKELGLNRVNSSVIKPDNAATRGAIFQISHLVSVEEIKD

SEQ ID NO: 8195 - protein, 167 aa, Lactobacillus casei
MASFIDPNQLDLEDQVVAINRVTKVVKGGRRLRFAAIAIVGDKNGHVGFATGKAQEVPEAIRKAVDAAKKSLIEVPIVGTTIPHEVIGHFGAGEVLLKPAEEGSGVAAGGAIRSVMELAGIADITSKSLGRNTPINMIRATMDGLSQLRTREQVAELRGVSASSLED

SEQ ID NO: 8196 - protein, 119 aa, Lactobacillus casei
VISKPDKNKTRQRRHARVRGKISGTSERPRLNVFRSNKNIYAQLIDDVAGVTLASASTLDKDIKDPENKTDAAAQVGALIAKRAVADGHKVVVFDRGGYLYHGRVAALAEAARENGLEF

SEQ ID NO: 8197 - protein, 176 aa, Lactobacillus casei
VSRIGYKVIKVPAGVTVTKDGDNITVKGPKGELTRHFVPEIEMHQEGDEISFTRPDDSYKAIHGTMRANLNNMVVGVTEGYKKEMKLVGVGYRAQKQGEKLVLNVGYSHPVEMTAPKGITVEVPSTTQIIISGISKQVVGQFAAVVRSVRAPEPYKGKGIRYVDEHVRRKEGKTGK

SEQ ID NO: 8198 - protein, 132 aa, Lactobacillus casei
MVLTDPIADYLTRIRNANMVRHESLVVPASKMKKDISEILKREGFIRDYEVIDDDKQGMIRIFLKYGKNNERVISGLKRISKPGLRSYVKSDAVPKVLNGLGIAIISTSEGVITDKEARAKNVGGEVLAYVW

SEQ ID NO: 8199 - protein, 180 aa, Lactobacillus casei; identical to SEQ ID NO: 1531

SEQ ID NO: 8200 - protein, 103 aa, Lactobacillus casei
MKFKTGDKVRVMRGKDAGKEGQITKVLKDADKVVVEGINMIKKHQKPNNANPQGGIIDKEAPIHVSNVMLLDPETNKPTRVGSEVKDGNKVRIAKKSGTAIDK

SEQ ID NO: 8201 - protein, 122 aa, Lactobacillus casei
VIQQESRLKVADNSGAREILVIKVLGGSYRKTGNIGDIVVATVKQATPGGVVKKADVVKAVIVRTKSGAHRADGSYIKFDENAAVIINADKSPRGTRIFGPVARELRDGDFMKIVSLAPEVL

SEQ ID NO: 8202 - protein, 87 aa, Lactobacillus casei
LAERNSRKVYQGRVVSDKMDKTITVEVSTYKTHPVYGKRVKYSKKFYAHDEDNSAKVGDIVQIAETRPLSRNKRFRLLNIVEKAVII

SEQ ID NO: 8203 - protein, 64 aa, Lactobacillus casei
MKAKEITALTTAEMLDKEKQYKEELFNLRFQQATGQLENTARLKQVRKNIARIKTVLRQQELNK

SEQ ID NO: 8204 - protein, 144 aa, Lactobacillus casei
MLVPKRVKHRREFRGKMRGAAKGGKNVDFGEYGLEALESHWITNRQIEAARVAMTRYMKRGGKVWIRIFPHKSYTSKGVGVRMGNGKGAPTGWVAVVKREKIMFEVGGVSEAVAKEALRLASNKLPIRTKIVSREEVGGQSNEG

SEQ ID NO: 8205 - protein, 220 aa, Lactobacillus casei
VGQKINPTGFRVGVIRDWDAKWYADKDFADYLHEDIEIRNFINKKLSEASVSRIEIERAAKRVNISIHTAKPGMVIGKGGSEVENLRKQLNKLTGRQVHINIIEIKKPDLDAKLVGENIARQLEQRIAFRRAMRQAMQRTMRAGAKGIKTQASGRLNGADIARREHYNEGLVPLHTLRADIDYAWEEAATTYGRIGIKTWINRGEILPEKPQQNSAKGGK

SEQ ID NO: 8206 - protein, 117 aa, Lactobacillus casei; identical to SEQ ID NO: 1524

SEQ ID NO: 8207 - protein, 93 aa, Lactobacillus casei; identical to SEQ ID NO: 1523

SEQ ID NO: 8208 - protein, 278 aa, Lactobacillus casei
VAIRKYKPTSNGRRNMSGSDFAEITKTKPEKTLLVSQSHTAGRNAHGHITVRHRGGGHKQFYRVIDFKRNKDGMAATVKAIEYDPNRTANIALLHYEDGVKSYILAPKGLKVGDKVYSGENVDIKVGNTLQLKNIPAGTTIHNIELKPGKGAQLARSAGVSAQLLGKDNDKYVTIKLASGEVRLVLGENRATIGAVGNEQHELISIGKAGRKRWLGFRPTVRGSVMNPNDHPHGGGEGKAPIGRPSPLSPWGKKTLGKKTRDHKAKSEKFIVRHRKTK

SEQ ID NO: 8209 - protein, 100 aa, Lactobacillus casei
MEARDIILRPIVTEQSMAEMDNRKYTFEVALHATKQQVRKAVEEIFGVKVVNVNIANVRGKKKRQGRYEGMTRRRRKALVALSADSKEIKIFADEDNDNK

SEQ ID NO: 8210 - protein, 207 aa, Lactobacillus casei
MANVTLYKQDGSENGTVELNDAIWAVEPNENVVFDAVVMQRASLRQGTHAVKNRSAVSGGGRKPWRQKGTGRARQGSIRSPQWRGGGIVFGPTPRSYAYKLPKKVRRLAIKSVLSQKLLDSDLVVVDGLNFEAPKTKAFQNVLDGLKVNEKALVVLEDGNEVAAKAARNLPNVKVVPAEGINVLDAVDYKKLILTQSALQKIEEVLA

SEQ ID NO: 8211 - protein, 210 aa, Lactobacillus casei
MARKGILGKKVGMTQVFTENGELVPVTVIDVTPNVVMQVKTVESDGYEAVQLGYGDMREVLTNKPSVGHAKKADTTPKRFVREIRDVALSDYEVGSEVKADEFAAGDIVDVTGTSKGHGYQGNIKKDGQSRGPMAHGSRYHRRPGSLGAIINKVFKGKKLPGRMGNRTRTMQNLQVVAADTDHNVLLIKGNVPGANKSFVTIRSAVKAAK

SEQ ID NO: 8212 - protein, 102 aa, Lactobacillus casei
MAKQKIRIRLKAYEHRILDQSADKIVDTAKRTGATISGPIPLPTERTIYTVLRSPHKYKDSREQFEMRTHKRLIDIVNPTPKTVDALMKLDLPSGVDIEIKL

SEQ ID NO: 8213 - protein, 145 aa, Lactobacillus casei
MKFDHYKKIVNAALDVLLGLLAIVVVVFMLRYIIDIGSMILRPLSADLFGKVIQEVTSFFMLFEFVIMLIRYIEEGHHIPIRYLILISMTAILRQLLVLHDRGTETLLLTLAILVLAGVLTVFSYVSGDFKHSRDEKDVDIDQHF

SEQ ID NO: 8214 - protein, 121 aa, Lactobacillus casei
VNSKYIIKNHTNTFLIRGHEYEVTAPAKFNRSTGELIDDKTLDDVALEIANEKYRQAMGIVSPADIKRYRTRVNLSQQELASLMGRHPATIELYEAGAFPAEADNRLLRALINDDATIVRK

SEQ ID NO: 8215 - protein, 256 aa, Lactobacillus casei
MLSLPALSFFFIAVFLISLGFLLIYRHGSQTARIGAAERHCPNCGKKVTSSAKFCPYCGTSLGRESKSTSKPKQYRYIYLPLLVAAVSTFLMFAGSSAFSRTASINKSVTETATNQQDSTDLVFSHLSRKDQLREIIFYGFSHSKTFKQNGISMTTFPPMGKGLVVHGYTKNSYSVYPYGYASGGVPLIEITQLQKDTGGTKTLVYFGMKTNTFYADSNSPVDTQNIDNFCNAQGGIKTLRSIKFREYNPNPVFEN

SEQ ID NO: 8216 - protein, 345 aa, Lactobacillus casei
MAEQNYCPHCGYKLIGKPKFCPQCGHPLTAETKEQVTMSKSHMFELRLDLGNLIPSRTHFITVLTFLKNNALTLFILFCVTTFLPVNSVRCWLLVAYLIFIYFYPLSTGKKRILWDERLDTWLQDKDSLHRFNEKVGKGFSQLQHVLPKEESHTTNTSEVAKSSGTTKDAISLQQKQTNTTTNKSQHHGFTWTGELICGIVSTVTGLVMYLVGKDATSSISSQAISVLQSGELDSGGYFYIWGIFLFGVGIAMLIGGTIKGITGHIRGGTLKIIAILICFVATIAATYVYSNPLTSAVNAAAYAYNSNTNIDTIQNLANIVKALPYIAGAIYGLGVLQNATTPKK

SEQ ID NO: 8217 - protein, 364 aa, Lactobacillus casei
MYTQKTKSCYRCGAIVSEDAKFCTSCGADLQSQVIRSTPSFDHKTETNSSFTKLSSFNKGKAILLKKSVRRKLWYAGLTALLVILVVGYIYSAKADALIANSLTSTTQQWISEANAYKPELTTAFGGFLATLFIIFGILNRRGFPAILASIIFGIVGATTSAGVTYVFTAGKVINAFETLATDRLSGSTQLFTLSYSHYLPSFMETNTAYDGGVYTFKPDGTLKVYTRTPYPVNAKITPQDAAMLYKESQDSTAEVEYGTWHVTNGTLHLKYGKFKIAADITIPSYSDIGNLADLSMKRRTVRIDNHRFESIQLSVAGEEALWSNKPDGKLNISFDGKTYTLKPDRKHQYSMSFNLYSPKSFSK

SEQ ID NO: 8218 - protein, 63 aa, Lactobacillus casei
MKKADIKTNINKSKMLDTNDDIYIHLQNCVLLIYKESLDVLKIITKIPLKVRKPFYFEKDFGE

SEQ ID NO: 8219 - protein, 761 aa, Lactobacillus casei
MLYNRFAQHVVNDKKKMYKRGSQWVVASAFALAIGGFGVTQTQSVHAAETQPQLTVQSATLVNKTDATTPSSAAVSQAAQAQAATVATSQAAAPAQQKATSTVSVQAAQPASAAAKTANDAVQTNAPAPSSASMTDEQWKAAKAKYDQAKADAAKQEAAAKSQAEAAKSAYADQLQKPAQVQKDTDVAALNKAQSEAQTSLASLKAAQASSYAAASTAAVKEVADLNSQKTSETIPVGDGGTFNYVAKTGSWSNIVNNDDLNNAKWNGNYLVQNLPVLSDSEVNSEDNQAYDNKANLFAAYQEGYGVVPAWAMKDTVKDDKLSKAQQYEVNQYAMMLTNNYRKALGLSPLITTSDFLGLVQQRGDSMLNDEVMHHDINIIDQLFRKFGGYGENLAQSFNPNWNKLHQDRDLTMLDVLQSVAGAVNNLFNYDQASEQGHRQTLLSEDYNFQTGGWSYQKIANGSWVLCFDAVTDKVAGENIATVPSQVDTSKDKEIDQKIANIQSALAALKSKQAKDYQNLESTLTSSETTLRDKVTNDNALLEQIVPKIKAYNSEQDSNVQKFIDSLNSKVEQLNPGAEPGTSTNNSGSSASSAGNSSASSAASSAGSSASSSAASSANNSSASSAASSATSSAASSAASSATSSAASSAGSSATSSASSSAASSASSSAASSATGPAATTPAGSNAPKPATSPAKPAAVTPLVKTEPASTQPLSRMTQKYGKHAYPATGESQNGIVLAEAGALIIAVLGFAGVRKYRHAK

SEQ ID NO: 8220 - protein, 187 aa, Lactobacillus casei
MSFIGQKLPAFSLTAYQNGDFHTVTDQDMRGKWAVICFYPADFSFVCPTELGDLQDHYDQFKSVGAEVYSVSEDTEFVHMAWAEASPTIKKVAYPMVADPAGTLASALDVRDAASGQAFRGTFIVDPDGVIQTYSVNNFGIGRNANEILRTLQAAQFVAAHGDQVCPANWQPGEKTLKPGAALVGKI

SEQ ID NO: 8221 - protein, 348 aa, Lactobacillus casei
VSSQERIVTILLRLLRGDVLTKQDLMAEFGKDESAIRRDIAAIRRLFDRELDEPDAFAKMPAGHYRLQSGLRAQGTKLTDGQLMAIGLILTASRGLATDEMKSLLRQLMPTGADHKGSDAVMRNPIFEYRGVPKMSLSDRLERLSQAVVNHELISFDFTYHGEQHHFDHKLPTGLFFGDLFFYLIVDGSDEQFENPDHGKFAKFRLDAISNLKFYGHHPTHNHDDRFQGGRLQVHTWYPYLGKPINLEIEYAYDPAYVTDRFPQAKVDPKPIRVDPDNGNPYARRVYHIEIAVNDGFGIRMWLLGQGALVKILAPKYLRDYVVWVFATSLKERYGISDLSHYHLSDNM

SEQ ID NO: 8222 - protein, 700 aa, Lactobacillus casei
MANKREFPLDRTRNIGIMAHIDAGKTTTTERILYYTGKIHKIGETHEGASQMDWMPQEQERGITITSAATTAFWKDHRVNIIDTPGHVDFTIEVERSLRVLDGAITVLDAQSGVEPQTENVWRQATTYGVPRLVFVNKMDKIGADFNYSLQTLHDRLQANAHAVQLPIGAEDKFEGVIDLIDMKADLYDEDELGTKWDTVDIPDDYKEAAQKAHNELIEAVADVDDGIMDKYLEGEEISNAELKAAIRKATINLEFYPVLAGSAFKNKGVQMLLDAVIDYLPSPLDVRPYHATDPESGDAVELTAGDDKPFAALAFKVATDPFVGRLTYIRVYSGTLEAGSYVLNATKDNRERVGRLLQMHSNHREEIPEVFSGDIAAAIGLKNTTTGDSLTDVDHPLILESLDVPDPVIQVSIEPDSKEDQDKLDVGLQKLSEEDPTFKAETNPETGETLIAGMGELHLDIMVDRLKREFKVAAKVGEPQVAYRETFTKEASAQGKFVRQSGGKGQYGDVWIQFTPNDEGKGFEFENAIVGGVVPREYIPAVEQGLKEAMANGVLAGYPLIDVKAKLYDGSYHEVDSSEAAFKVAASMALKNASKSAGAVILEPIMHVEVVAPEEYLGDVMGQITARRGRVEGMEARGNAQLVNAMVPLAEMFGYATTLRSATQGRGTFTMTFDHYEPVPKSIQAEIIKKNGGGVATKE

SEQ ID NO: 8223 - protein, 156 aa, Lactobacillus casei; identical to SEQ ID NO: 1513

SEQ ID NO: 8224 - protein, 138 aa, Lactobacillus casei
MPTINQLVRQGRKSKTTKSDSPALNFGYNSKKKSLTSNPAPQKRGVATRVGTMTPKKPNSALRKYARVRLSNLIEVTAYIPGIGHNLQEHSVVLIRGGRVKDLPGVRYHIVRGALDTAGVDGRMQGRSKYGAKRPKKK

SEQ ID NO: 8225 - protein, 3214 aa, Lactobacillus casei
MKELGVKKTRHRLFKVSVYFTVILGMIVQLLSPALTLAAENPTQAVTGTLTIKNQDEQGKSLNGAKYEVRNESHQVVANSAISKDGQTIVPNLPVGNYTATETESASGYTAIEQTKNVSVTASGNEMLLFKSRASATITSSSSSSSAAASSAAQTASAQEPAKSATPDAKADTTLPNIFTKVVLKDGNGQPLGTEVNQQSTVKMELTFTLPETSTPFPAGASFTTQLPKDQIDFPPSSTGVFDGGVAEYQFDQTTGKLTIKLLKATDNGSWRVNITASFKALTANDSLNQTLVFHTKDNDTKFPITFRSNAKPVVVNAPKVTPQNLNPTGISGSAKFNLNGAESDKTNPPKWDSDPAKRSKNADMELTVTAQGSGTTYPKSLTFSDSDPAKIKVSSASVNVLGDFSEALKPLVAGRDYHAVLSDDKRTVKIYLTDGLKKSTGYQVDYTASIDRSLDDTGKVGSALVEGYRYLTGTKSYDGYDYSSVTMRNSGVAITKAGDITNNFRALKWKINWNYSMDTMKAGATLTDHFGKQIGGTDDHNQPKIEQDANQSLDTSSLKVFQVTFDQNASPTVSKDNIAKYFKLTDKGNGTFTLTYLGGAKLPDNASFQVQYQTKLKTTPANGTKLTNIVNDQKDHYANATYQVSLPNSIDKTAGNIDTYNAQMMWRINANQTFREMRNGKIFDLFPDGVDKLGDDPTAADINTINGENASTDDQDGSNDGILVYAQDPDGKRTLLKSGTDYAMSTSDNDVQTAVKQYNAKDKENPIDADGQTKGIRGFVVTLKGKYADTDSQIVIYTHTKLDMLKLGQVANDPDALKKALNNRAFFFFDLPPGSHDTASGSSSNTPTPEEGAFSGALKNSWSDTPDTQYWGVLVNRLGVKYGHLHLTDILPRFDGVNYELIPDSIKFYEVTGSDGIDPSNTGDPTTSGDVKEIKTNPYYGTSGWSTTALKADDAAQQDLLPTNTPNTWLTDNKDLAQQLDFDFPNIGNGRVWVVFETKRANQWSYNDPNFTNTATVTDKNQATTDIPKFTPSASKSAQSYWTPINKTVSRDSKLKNVLNWHVQLENIQDKYRPMVNPVIEDTLDPSGTGAEINATSFKVTLQVGSANEVTLKQGKDYDLALNGDKFTVTFHRTFGNLTQTDGSPLNNYHVNVYYATSSKNAGWVYNTSKVSWSGDETTNQPSDGVPESGRTASTQGYLPSWDSGISGETITQLANLVVEKKDKVSGAPIPGIKFRLSDGTHTFEATTKLDDQTHKATATFQGLPIGVDYTLTELNTPAGYKPLAPQKIRLKATSDTGTAIQNEAVENEPYQITLSKYDNRAKGQSAADSKQYRLSGATYDLIDTDNQQKLLSGLKTNDDGQITVGTATSFAGSYTDGKFKPDLKAGQYVLEGLKPGHYRLVEREAPIHYRGDAHDQATVTSGPDKQLWIDSLNAGSVNATIDDKTPNAQVTAYNQKKPGQLAIKKQAETIKDDHFPDRQPMTGATFKLYRYGDDGKLDYDKSWEATVTNNDGTVSFSGNDLYEGKYQLIETKAPEGYVIPNDLAKGVDVNITGDQTLTYPTIEEPVFRRTVVLKKSDGNFGNPIAGITYALYQEDGTELAKDLVTNKDGEVALPFDLPAGQYYFKETKTLPPYRLNTDKHAFTIKQTDQTQTAAALASDNKQKPVTVNVTNYQVKTLNVKKVDRTYAKHALPGAVFRLTNSTGYSRDVTTDENGVASFGDLLLGHYSLTEVKAPAGYRLDTTIYPITLASAATPSAITVNKEIADDPYQVTLTKYDNRVKKTDDAATLKKYLLPGATYKLVDEVTGKTLKADMKTNADGQLTFGAASSFDTPLKAGEYAIEGLKPDNAYRLVETEAPEHYRGDAKDQANLTSGAGRQLWEDSLKAGSLDFTIKADQTQLSLTATNQKKPGQLTIKKQAETIKDDHFPDRQPMTGAQFKLYRYGEDGQVDHDKSWTETIANNDGALTFKDNDLYEGKYQLVETKAPEGYVIPNALAKGVDVNITGDQTLTFPTITEPVYRRTVMLEKTDGNFGNPIAGITYALYQEDGTELAKDLVTDSKGQVHLPFSLPAGSYYFKETKTLPPYRPNTDKHAFKVEQADLTQTANALATENEQKPIAVNVTNYQIKTLNVTKVDRNYTKHVLPGAVFRLTNSTGYSRDVTTDENGVASFGDLLLGNYDLTEIKAPSGYRLDTTVHPITLSSAVTPTPIKVNKEIADDPYQVTLTKYDNRVKKTDDAATLKKYLLPGTTYKLVDEVTGKTLKADMKTNSDGQLTFGTASSFDTPLKAGEYAIEGLKTDNSYRLVETEAPDHYRGDAKDQADVTSGTDRQLWEDSLKAGSLDFTIKTDQTRLSLTATNQKKPGQLTIKKQAETIKDDHFPDRQPMTGAQFKLYRYGEDGQVDHDQAWTATITNQNGIVTFNDHDLYEGKYQLVETQAPRGYVIPDELAQGIDVHITGDQSLALPAITEPLYRRTVQLEKTDANFGNPIAGITYALYRSDGTELANNLVTDKNGQVKLPFDLPAGAYYFKETKTLPPYRLNVDKHSFKVDQTDLTQTATALATENKQKPIAVNVTNYQIKTLNVTKVDSTYTKHALPGAVFRLTNSTGYSKTATTDENGVASFGDLLLGNYALTEIKAPSGYRLDTTVHSITLSSAITPTPITVNKEIADDPYQVTLTKYDNRVKKTDDAATLKKYLLPGATYKLVDEVTGKTLKADMKTDADGQLTFGAASSFDTPLKAGQYAIEGLKPDNAYRLVETQAPKHYEGDATDQARDTNGTAKQSWQQSLEAGSVDFTLTANQAQLKLTATNQKKAGQVVITKKAATTHDDRFPAKMTMIGAQFALYRYRDDGTVDNSRSWKATITNQNGIVTFNDHDLYEGKYQLVETQAPRGYVIPDNLAKGIDVNVKGDQKIDLDPIIEPEFKRTVQLQKTDGDFGNRLAGITFNLYGSSGNILAKDLVTDKNGQIDLPFNLPIGDYYFEETKTLPKYALTTDKIRFKVEQTSLTQTASALATQNKQQPITVQVANYQINSLIIKKVDAADQQKVLAGAVFRLTNDQGYSKEITTDAKGLATFDNLKLGRYWLTEIKAPSGYTINSDYAKPVAVEIKSGDAVRMTIADQPHKTLPDTGGNGGNNGGATNPSGTPSTPSTPSTPSTPSTPSSPSAHSNNVRHEQPSRRLLFGSFGDRDAMTLILAGVVILIIAGSTVILRRRKQS

SEQ ID NO: 8226 - protein, 165 aa, Lactobacillus casei
MISGLMLLSVAKFTMDLTADNRYFHCCLAVLLGMVAQTWLTLLLSVGLLIFSVADWRERAVSAVWFGSWCFLLLLLFPCDWFNVCLLAALVGGLAVVSHGLGSADVLLIAVFGGILQLEIALIITCMACFSAVIHWLVAHPPSLPFISHLAVGYGCVQLASGWLF

SEQ ID NO: 8227 - protein, 1225 aa, Lactobacillus casei
LIDVNKFESMQIGLASPDKIRSWSYGEVKKPETINYRTLKPERDGLFDERIFGPTKDWECACGKYKRIRYKGIVCDRCGVEVTRSKVRRERMGHIELAAPVTHIWYFKGIPSRMGLVLDMSPRSLEEIIYFASYVVIDPGDTPMEKKQLLTEREYREKREEYGKTFNAKMGAEAIKELLQDVDLDKEVTELKDDLKSAQGQKRTRAIRRLDILDAFKESGNDPAWMVMDTIPVIPPDLRPMVQLEGGRFATSDLNDLYRRVINRNNRLKRLLDLNAPSIIVQNEKRMLQEAVDALIDNGRRGRPVTGPGNRPLKSLSHMLKGKQGRFRQNLLGKRVDYSGRSVIDVGPWLKFYQCGVPREMALELFKPFVMRELVKRDMASNIKNARRKIDRQDDDVWDVLEDVIKERPVLLNRAPTLHRLGIQAFEPVLVDGKSIRLHPLVCEAYNADFDGDQMAIHVPLSDEAMAEARMLMLAAHHILAPKDGKPIVTPSQDVVLGNYYLTMEQKGREGEGMVFKDTNEILMALQNGYVHLHSRVGVAANSFTNKPFTDDQKQKIMVTSVGKAIFNEIMPKDFPYLNEPTQDNIVNGVPDKYFIDKGEDIHAYLADAPLIDPFKKGFLSDIIAQVFKVYKVQRTSDLLDDMKTLGYTQSTNSGLTVGISDITNLKEKPEIVAAAHKKVATVSKQFRRGLITDDERHDRVIQIWNDAKDEIQQKLVDSFDPNNPISMMSDSGARGNISNFTQLAGMRGLMAAPNGGMMEVPVISNFREGLTVMEMFMSTHGARKGMTDTALKTADSGYLTRRLVDVAQDVIVREEDCGTDRGLVVRAIREGNEMIEPLYDRLVGRFTMKDVLDPKSGKVLVKRNTLMDEDMAQKIVDAGVEAVTIRSVFTCNTKHGVCQKCYGRNMATGEQVEVGEAVGTVAAQSIGEPGTQLTMRNFHTGGVAGGEDITQGLPRVQEIFEARNPKGEAVITEVTGEVTAIDENPAEHTREITVKGETDTRTYSVPYASSVAVAEGDHVNRGERLTGGSIDPKQLIKVRDVMATENYLLSEVQKVYRMQGVDIGDKHVEVMVRQMLRKIRVMDPGDTNILPGTLLDIADFKEKNTQAIISGGIPATGRPVLLGITKASLETNSFLSAASFQETTRVLTDASIRGKNDPLVGLKENVIIGKIIPAGTGMATYRHEEPKSVGTVSDSVYSISDIEKQMKEKDSQQKDDQQDDTDNK

SEQ ID NO: 8228 - protein, 1195 aa, Lactobacillus casei
VNYGKHRTRRSYARIKEVLDLPNLIEIQTNSYQWFLDEGLKEMFDDIMPIDDFQGKLSLEFVGYQLLEPKYTVEEARQHDANYSAPLHVTLRLTNHETGEIKSQDVFFGDFPLMTKQGTFIINGAERVIVSQLVRSPGVYFHSETDKNSRVTYGTTVIPNRGAWLEYETDAKDIAYVRIDRTRKIPLTELVRALGFGSDQDIINMFGDNDSLMLTLEKDVHKNTDDSRTDEALKDIYERLRPGEPKTADSSRSLLYARFFDPKRYDLASVGRYKVNKKLSLKTRLLNQVLAETLADPDTGEVIAQKGTKVDRQVMDKLGAYLDRDDFKTVTYQPSDQGVVTDPIVLQSIKVYSQVTPDKEINLIGNGHIGKKVKHIVPADVLASMNYFLNLQEGLGSVDDIDHLGNRRIRSVGELLQNQFRIGLSRMERVVRERMSIQDTATVTPQQLINIRPVVASIKEFFGSSQLSQFMDQTNPLGELTHKRRLSALGPGGLTRDRAGYEVRDVHYTHYGRMCPIETPEGPNIGLINSLASYAVVNPYGFIETPYRRVSWDTHKVTDKIDYLTADEEDNYIVAQANSPLNDDGSFVDDTVLARHKDNNIEISPDKVDYMDVSPKQVVAVATACIPFLENDDSNRALMGANMQRQAVPLINPHAPLVGTGMEYKAAHDSGTAVLATNAGTVEYVDAKQIRVRREDGALDSYNLMKFKRSNAGKNYNQRPIVTIGDHVDVDEIIADGPAMQNGELALGQNPIIAFMTWNMYNYEDAIVLSERLVKDDVYTSIHIEEYESEARDTKLGPEEVTREIPNVGEEALKDLDEFGVVRVGAEVRDGDILVGKVTPKGVTELSAEERLLHAIFGEKAREVRDTSLRVPHGGGGIIQDVKIFTREAGDELSPGVNMMVRVYITQKRKIQVGDKMAGRHGNKGTVSVVVPEEDMPYLPDGTPVDICLSPMGVPSRMNIGQVLELHLGMAARNLGIHVATPVFDGANDKDLWSTVKEAGMASDGKSVLYDGRTGEPFENRVSVGVMYYMKLSHMVDDKIHARSIGPYSLVTQQPLGGKAQFGGQRFGEMEVWALEAYGAAYTLQEILTYKSDDVVGRVKTYEAIVKGEPIPKPGVPESFRVLVKELQALGLDMKVLGADKKEIELRDMDDDEDDVVSVDALAKFAAQQEEKKAHEAAAQASDGKPADNSTDDKK

SEQ ID NO: 8229 - protein, 210 aa, Lactobacillus casei
MGKQQKYIKRAFLDLLKENDLHSVSIRQLVQKADVSRSCFYSYYSDKYELLQEIEDDLIAGFVSIMKKVRQHSVGYFYEGITHRNYPIYTEYFTYIKQHQEVFTILFSARMGDDFTNRFSRAIAKTRHDTLRFWHLEPEPNPWLAFQENLLAASYVSIIKTWLNQDCQPSIEEMGAYLSTLWRPGFFYNEDQYQRAVRYMDDNRATVLSR

SEQ ID NO: 8230 - protein, 353 aa, Lactobacillus casei
MDTLKIAIYGAGSIGTISGAYLSAAYGKDHVTLIDTWPANVAALNAEGAHVIGTTDFTTPVTAVMADEVVDQFDLILLHTKQVDNAKVIPAVKQLLKPDGTLVSLQNGVPERYVLTHIPAKNLIAGSVVFGATGAGPGVTELTTAYDSFKAHAYQIGEIDGTITQRTELVQTILSHVGMTLISNELMGTKWSKLLVNAAFSGLSTIMNRTFGEVAQDDIGVKSALHILNEGLNVGQADGITFTPLSGVDLAATFGLTGDDFTDTQIATLRLMTGASAKLKASMLQDLYKQRKTEVDYINGLITATARDHGIATPFNDLVVKLITEAERTHTIPTFEVAKAELQQLLDHRAVVS

SEQ ID NO: 8231 - protein, 226 aa, Lactobacillus casei
MAVETKTDKLMWPIEAIQPVKDGDTVVLGGFGPLGYPAQLVKALYLFSDAKDLHIALNAPNGMYLPTLDRLIAERASHLTTTFVRTSRAATKFFKEGKLTLTPQGTFAERLRAAGAGIPGFYTPVGIGTMVAEGKEVKEFNGRQYLLEEALNADVGFMQATKVDYDGNCYIEGAMKSFGALVPAASKYTVVEAEEIVPVGDIPSELITVSGIYIDGIVKVGMRHDQ

SEQ ID NO: 8232 - protein, 224 aa, Lactobacillus casei
MISRTYIAKRVADELEDGQIVNLGIGIPTLIPKFISDDKHIIFQSENGIINIGPAPKPGEPENPNIFDAGGSPATIKPGGQFIDSAKAFGLIRSGKVDVTVLGAVQVDAQGNIANWIIPNKMLVGFGGAMDLVTCAKEVIVAMEHTAKGQIKILDECTFPLTGAHCVSKIITELAVFHITDHGMVLTEISPKTTLDEVRARTGAHFNVADNLKVSQIADEAVEV

SEQ ID NO: 8233 - protein, 104 aa, Lactobacillus casei
MRMNKRLAKNLHRSLFGKFKVIMQYKADWYGNTLVLADRFYPSTQRCSNCGYVKTADERVTLSGNLKHQTGHDDYHCYQCGVKLRRDENAVENLIAYAKSKVTG

SEQ ID NO: 8234 - protein, 398 aa, Lactobacillus casei
MPETKDAVIVAYGRSAVGRSLKGALTNEHPVDYAAEVLTGVLNKVPQLDVNDIDDVMVGCALPEDVQGLNVARMISQRANLPDSVPAQTINRFCSSGIQTIATGANAIMANQADIIVAGGVESMSQVPMSFDMAGINPTLRAEKPQDYMPMGLTAEVVAEKFQVPREKMDEFAMHSHHKAAAAQEAHAFDDQIIPVHYGDIEGHTKVFDKDEGVRGNLTMDQLAALPPAFKEDGGQVTAGTSSPLSDGTAFVILMSADKAAELGVKPIARFVGYAVAGVNPAVMGLGPIYAVPKVMARTGLTIDDMDSIELNEAFASQSLVCIDKLNLPVDKVNPRGGALALGHPLGATGAILTCKILSYLQATGGRYGLVTMCIGGGMGAAGIYEMIPDEETAEATA

SEQ ID NO: 8235 - protein, 170 aa, Lactobacillus casei
LTDRQVIQTRLVLPGDTNAHNTLFGGKLLSYIDDVSAIAAVKYSQRIVVTASTDSVDFRHPIAANDSVTLTAFVSGVGTRSIEVFCRVMGETLTTGKTYLATTAFSTYVVVDGQTTPLPSFTPVTAEERLLFSGYPERRTARKARRDRNRAFISQLETAEDDPQSLTQKN

SEQ ID NO: 8236 - protein, 835 aa, Lactobacillus casei
MDNLFTPSAKNVLLLAQEQAKYFHHHAVGTEHLLMALVMEKDGIAGKTLRQLGVTENDVHDEIERFTGYGTVDAAGQASDSYLPYSPKGKEILAFAGDEAKRLGALKIGTEHILLGLLREDDILAARILQNLGLSLSKTRQMVFKKMGIADTAAKRRPMARGGARQDSQGTPTLDGLARDLTQMARENRMDPVVGREKEVRRLIQILARRTKNNPVLIGEPGVGKTAIAEGFAEKIVAGKVPDDMLNKRLMMLDMGSLVAGTKYRGEFEDRLKKIIDEIYKDGNVILFIDELHTLIGAGGAEGAIDASNILKPALARGELQLIGATTLDEYQKYIEKDAALERRFATIQVDEPTEEEAEQILKGLRPRYEAHHGVTITDEALHEAVVLSSRYITTRFLPDKAIDLVDESAAKVRLDKANVETKSDKLQDELAKLVADKEDAIDHQDFETAATIRTKEADVKAKLADTPEPVNESGVRTDIKVTGADVAEVVSQWTGVPVTQLQKKESERLVNLEKILHQRVVGQDEAVSAVARAIRRARSGLKDPTRPIGSFMFLGPTGVGKTELAKALAEAMFGSEDAMIRVDMSEYMEKFSTSRLIGAAPGYVGYDEGGQLTEKVRNKPYSVVLLDEVEKAHPDVFNILLQVLDDGYLTDAKGRRVDFRNTILIMTSNIGATAIRDDKTVGFGAKDPTADFKAMKSRMLDELKKSFRPEFLNRIDETVVFHSLNKEELHEIVKIMTKTVLSRIKDQGIDVKITPAGIDAIAAAGFDPEYGARPIRRALQTDVEDQLSELLLTGQAKTGDLIQIGAKKGKLTFTVKENKGKHKENGASKEPVKA

SEQ ID NO: 8237 - protein, 155 aa, Lactobacillus casei
MQRENISDIIEAYLKTILAQEAAVEIRRAEIARRFNCVPSQINYVIKTRFTPARGYIVESKRGGGGYIRIVKVKLTDDQDFIQIMRQHIPKRLRLRDARDLIQELFDNGLISQQSGNLLLAVMNHETLGILDQGTEEHLRSRMFLAFLDRLRYER

SEQ ID NO: 8238 - protein, 499 aa, Lactobacillus casei
VLAKENGQQPEMNDQMIARREKMEALREAGIDPFGHRFDRTHSAAQVREDFGEDDKETLLEEKPKVTIAGRMMSKRGKGKVGFADIRDRSGKMQIYVRKDVVGDENYMIFKKADLGDILGISGEVMKTDSGELTVKANHVTHLAKALRPLPDKWHGLTDVEQKYRKRYLDLISNPDSFDRFVKRTKIVSAVREYLDNHGFLEVETPVLHNQAGGANARPFITHHNALDIDLYLRIALELHLKRLIVGGMERVYEIGRVFRNEGIDTKHNPEFTELETYAAYWDLTDVMTETEGIFRFAAHKVLDSGKLTYQGMDIDLDAPFARINMVDAIKDKTGVDFWPEMSVDDARKLADEHDVHYEPYWKVGHIISAFFDQFVESTLIQPTFITGHPIEVSPLAKKNPKDPRFVERFELFVGGGEYANAFTELNDPIDQRQRFEAQAAEKSAGNEEAQGIDDDYVEALEYGMPPTGGLGIGIDRLVMLLTDAPSIRDVLLFPTLRP

SEQ ID NO: 8239 - protein, 333 aa, Lactobacillus casei
MWHIANVEIPNRLVVAPMAGVTNAAFRVTAKEFGAGLVVCEMISDRGIMYKNKKTLSMMFVDPREHPISIQIFGGTKETLVNAAKFIDQNTAADIIDINMGCPVPKVTKTDAGAHWLLDPEKVYEMVAAVTDAVSKPVTVKMRTGWDEDHIYAVQNALAAERGGAAALAMHGRTRKQLYSGHADWNILKEVKQHLTIPFMGNGDVRTPQDAKRMLEEVGADAVMVGRAALGNPWVLKQMAAYLDDGELIPEPTPREKIATAKLQLQRLVDLHGEHQAVREFRMQAAYYLKGIPRSAKTKAAVNMVDTQAEVNHIFDDFVEQTEARARERQRSH

SEQ ID NO: 8240 - protein, 294 aa, Lactobacillus casei
MSDYIASALSRDTHFRIFAVDATETVREAQRRHDTWSAASAALGRTLVATALLSASGLKNRDDMLTVRIKGDGPVGSIITDGTEIGTVRGYVQEPHVNLPLNLVGKIDVARAVGKHGMLAVTKDIGIGEPFTGQVPLVSGELAEDFTYYLAKSEQIPAAVGLSVFVNADNSVQVAGGFMLQALPGADDAELSALEANVKTLPLVSELLKSGLTPEQIIQRIAGDAPVQFLDTQSLRFACNCSKAHFGDIMATLPHEQLQEMIDEDGGAETTCKFCGNQYHYSVADLEALIARHE

SEQ ID NO: 8241 - protein, 226 aa, Lactobacillus casei
NADPHAZREDCTASELISHIGVILGTTRKNALGARIFNYLKQAFPDTSEVHYTWLDLRDYPLPLYDHPETPLEDPIQEPTPIETKWLTAVANQDGYVILTPEYDHALPGGLKNALDLIGPEVEHKPVQIIGYSHFSDGGMLAAASLVPILQMLKMIVLPTPTLLWSADPCFDENGQINFAAANSQHFARRLHETMHDIGFYTRLLKEHPYQPLVSDTAANQTSATK

SEQ ID NO: 8242 - protein, 715 aa, Lactobacillus casei
MKKKQNGLFSSTLTYIIIFVLLVTGFAYYMRDNGTTSSQEIETSTFMSELKKDNVKSYSLQPSGGVYKVSGEYKKAQKSSGANNSLSLFGNQTTKVTKFSTYIPTNDATLSQIQKMTSANNVKTDTQEESQSGVWFSLLITVVPIVIMMIFFYMMMNQAGQGGGSGRVMSFGKSRAKQADKNANKVRFSDVAGAEEEKQELVEVVEFLKDPRKFSALGARIPAGVLLEGPPGTGKTLLAKAVAGEAGVPFFSISGSDFVEMFVGVGASRVRDLFDQAKKAAPSIIFIDEIDAVGRQRGAGMGGGHDEREQTLNQLLVEMDGFTGNEGVIVIAATNRSDVLDPALLRPGRFDRKILVGRPDVKGREAILKVHAKNKPLAPNVDLKEIARQTPGFVGADLENLLNEAALVAARRSKKAIDAADVDEAEDRVIAGPAKKDRVISPKERNMVAFHEAGHAIVGLVLSDSRTVRKVTIIPRGRAGGYAIMLPKDDQFLLTKKELTEQIVGLLGGRTAEEIIFGVESTGASNDFEQATQIARSMVTQYGMSDRLGTVQLETEGQPFLGAQYGQTPPYSETTATAIDDEVRRIIDEAHKQAYEIIQAHRQQHKLIAEALLKYETLNEKEILSLFNDGKMPERDQDEFPSEKAATFEESKAALEHKDKEKQADEEANAKSESDSQASQDHASQDDDTGGLEKPDDTSADSGSSDNNEHQDPQA

SEQ ID NO: 8243 - protein, 181 aa, Lactobacillus casei
MNPDILKVLYSQDDIHAITARLGAELKHDYAGKNPLVVCILKGAIMFMTDLVREIDDYMELDFMDVSSYGDATESSGEVKIIKDLDASVKDRNVLIVEDIVDTGRTLKYLTDIFKTRKAKSVRICALMDKPEGRVVDVQADYVGTTVPNEFVVGYGLDYAERYRNLPYIGVLKPEVYAAKS

SEQ ID NO: 8244 - protein, 435 aa, Lactobacillus casei
MSPKLFQTFGFAPHTRVLVAVSGGVDSMVLLDLAVRAPDLDVIVATFDHRLRPESRQEQAFVVAAAARYHVPVVTGVWHRESTDTASEAAARQARYEFLAASAETQHATVVMTAHHADDQLETVLFRLGRSGDPAVLVGIRADQSWHGKRLVRPLLGYSKAALRAYAQAHDIEFRDDASNNDTRYARNQLRHEVIPAYKRQNPQLLAHIQRFTVEQAGMLALADAEVSRWQQRLQVDPVTIDWQAATRLPKAVQFVLLKRMLRQWQPEVDEKLLPEVMHHLFAQSEHRFDLGIGVIIAVQNGRIRKLVLQPAMTPVTFTQIGQTVKTPRGTFSLQTEALHCKGVPVQVRLPVTLRTRQAGDQVRLPNGVTQKLRRFFINEKVPASQRDQLLLLAQDHQVFWIEGQPLERLSPPAQTDILHVVLVHSPDVDRSEDR

SEQ ID NO: 8245 - protein, 161 aa, Lactobacillus casei
MAVEVGTKVTGKVTGITKFGAFVELGDGKTGLVHISEVSDAYVKDIHDVLHVGEPVTVKVLSIQDGKIGLSIRKAVDKPQQREHENNHHEGRHAPSAHPGNNRFQGGARNGGNHFGHKAQQPAKGDFDAMMSGYLKESEDRLSVLRRNTEGKRGGRGGRRS

SEQ ID NO: 8246 - protein, 133 aa, Lactobacillus casei
MAKNNISQLNNAYTREHTAKKQRAPKSRAHAVHMKRIRNLLILMVVILGLGGFSVVRTQMTLGETNHAVTKAKANLDKLKANKAALKVQVDQLHNDDYTAKLIREKYLYSKPGEVIFNLPDKANKIPNLNVSQ

SEQ ID NO: 8247 - protein, 87 aa, Lactobacillus casei
MRLDKFLKVSRIIKRRTAAKEIADKGRITINGKVAKSSSDVSVGDTLVINFGNKTLTVRADDLVETTKKNDAADMYTVLKENYKETF

SEQ ID NO: 8248 - protein, 524 aa, Lactobacillus casei
MHNQQMKYLMRGAWILSLSSLIAKILSAVYRVPFQNMVGDTGFYAYQQIYPIYGLGMTFALSGFPVYISKLVAEADGDEAKLTVAHQSNVILNWVSWALFLGLEFFGQEIARAMADPELLPLIQIVAFMFLTMPVLATGRGYFQGTFDMVKTATSQVVEQIVRVGVILLAAWWFVQYHWSVYQMGAIAMSGAFFGGLAAVLTLWRPYHRVFGRRRFRFPGVQAYAHLISRFVREGGAITLYAALLILLQLVDSFTVTKGLTSSGIAMATAKSLKGIYDRGQPLVQLGLVVAASLSTTLLPSLTQARQLQQRRQFIQRGAELVHFNLAFALAATSGLAVLMPAIDLLLFGDTAGAFVLQLYAIAIAVVAMINAYNAILQSLDRYKGISVALLIGILIKAGINQPLVARFGTAGASGATILALGVILCLIYYAVPETIKGRSALRLFVPKLLVVTGLMVLTVYLAVGWIPLSSRLVALGVTILGVVLGVIVFLLTGTWFKLLTLREMLDLPGGKKYLKFVRKIKAR

SEQ ID NO: 8249 - protein, 1175 aa, Lactobacillus casei
MNLIDMVQADPELSALWPKLKTGRHLVTGLSGSAKTVFFGALLQQRQQQLLIVENNRFHADELAADLSSLLGDALVYDFPVEDVLAAEVAVSSPETRNDRINALTFLQSGKPGIIVTSLAGYKRILPAPAVWAASELVIDMDSELEPQDITKQLIAMGYRRDSLVSAPGQFAIRGGIIDIYPLNQDDPIRIELFDTAVDSIRTFDIATQRSLKKLTRIVISPATDMIASDQVLSATGERLVKQATAYKAKVKDADTKQAITDGLLTTGQQLQALERPENLALYAPELYPEHQRITDYLTPDALVVFDDYSRLLDSDTHLVQETAEWYAQLQTEGRLLPKTPNPKIQELNQHEPHPRLYLSLFQKGMGQLRLDSLTNVPSRNVQQFFSQMPLLKTETDRWVKQKQTVVFLIADKNRLDKLSGTLKDFEISNVLTEPNHLLPGQVQLTEGSLKNGFELPDMKLVVVTEHELFNARQRRRARHQTLANTERLRSYNELKPGDYVVHVNHGIGQYTGMETMEVDGVHRDYITIVYRNNDKLFIPVDQLNLVQKYVSADGKAPSVNKLGGTEWQKTKRKVAARIEDIADELIDLYAKREAEKGYAFGPDDDLQQKFEDEFPYPETPDQLRSAKEIKRDMEKPKPMDRLLVGDVGFGKTEVALRAAFKAIDYGKQVAILVPTTILAQQHFDTMKERFADFPIKVGLLSRFQTPHQNKETIKGLKNGTIDIVVGTHRLLSKDVAFRDLGLLVIDEEQRFGVKHKERIKQLKSNVDVLTLTATPIPRTLNMSMLGVRDLSVIETPPTNRYPIQTFVMEQNPGVIREAIEREMERGGQVFYLHNRVEDMERTVSQLEELVPDASIGYAHGQMTETQLENVIYDFLHGAYDVLVTTTIIETGVDMPNANTLIIENADHYGLSQLYQLRGRIGRSSRIAYAYFMYQPMKVLNEEAEKRLQAIKDFTELGSGFKIAMRDLSIRGAGNLLGKQQHGFIDSVGYDLYTQMLQEAVNKRRGIKTAQKTDAEIDLGLEAYLPTDYVADSRQKIELYKRIREANSDEAETEISEDLIDRFGDYPQPVTNLLAIAHLKRFADLAWVNSVQKTDQKIAVVLSPQATTKAQGEPIFKALAATTLKAQVAIADGKLTVTLTIPKTMQAGTWLAQLTAFMQGLVNVVNPQPEKKPAA

SEQ ID NO: 8250 - protein, 185 aa, Lactobacillus casei
MKMIVGLGNPGRKYAGTKHNMGFMVVDELAKRLGLKLDKLEFDAATATTRIHDEKVFLVKPQTYMNASGRAVRELMMFYQIRLDEILVVHDDMDLTLGKLRLRQRGSAGGHNGIKDIISATGSDEFFRLKIGIQHPQRQRVVDWVLTPFSQADQPTIDDAINRADDALEDWLNGMPFPQLMNKFN

SEQ ID NO: 8251 - protein, 326 aa, Lactobacillus casei; identical to SEQ ID NO: 3223

SEQ ID NO: 8252 - protein, 456 aa, Lactobacillus casei
VNKNKRWLLVVGALVVLLGGFYIVRSMHYRDHFLPNTEILGIDVSGQSVNAANKKLVKQFNERQYTFVEDDKKVMKVKGRALGLSQDFKKGLSQALNKQNPWLWTTSIFAGQKAHADEDPSINSVALKQFADTTANKLNQGRQEPVNAKLVADGTQFKIQKEVNGNQIDADKLAKTVTTALDNHRQTVNLTDTYKKPTVKASDSSLQTTERDMNKLAGTKVSLQIQSKTVTVPQATVMSWVTNDNGKATVSSQAITNYVSTLSQQYSTINKTRQFNSQQQGTVSVPAGTYGWSINVTSTAAMILASVKAGQDLNKEVVHSGSGYATDGDIGNTYVEVSKEKQHEWFIKDGKVVMDSDIVTGKPSQETPSGVFYIWSKQRNATLRGKNDDGSSYASPVSYWMPIDYTGVGLHDSPWQPKYGGDWYKEHGSHGCVNNPPDFMAKLYAAVDEGTPVIVY

SEQ ID NO: 8253 - protein, 221 aa, Lactobacillus casei
MLIKSLVLKKEFLTTVKETVTLEEALKILEDSGFRCVPILDESGTIFRGNIYKMHIYRHKSQGGDMSLPVTYLLKNATKTIPVNAPFFKVFFNIKDLPYIAVLDENANFYGILTHAKLLGMLSEAWNVDVGSYVLTVMSTGERGDLAKMSKILAKYVSISGCITLDAKRDEFVRRTLFTLPAGTDENTLNEIVSRLEKKSFRVVEIDDLQSGQPIRVDEEL

SEQ ID NO: 8254 - protein, 232 aa, Lactobacillus casei
MKTLTHFWDRIVFTVRFLRTHHFKPKFRKQLFFFAVLVPVCLVTIITGQQVEKPVPAATIFRTGTTLAKVSQSSHQPTSKVALNVTKKIDWQAPSENQPYPDLTQHPHLSLVVSLNKQRVFVKDGAKTLYTMYASTGIDDSTPHGHFKIQSERGYDFFNPEEQMGAHYYTSFYLHGTYLFHTVPTDINGQYIESEAAKLGQKPGSHGCVRLSIPDAKWIFETVPTGTPVVIE

SEQ ID NO: 8255 - protein, 127 aa, Lactobacillus casei
MDVTVKRGDVFFADLSPVVGSEQGGNRPVLIIQNNVGNHYSPTVIVAAITSKIQKPKMPTHVGLRAKQDGVERNSVILLEQIRTIDKQRLQARVTALSSAKMAAVDRALAISVGLVSLPKPKTYNKN

SEQ ID NO: 8256 - protein, 82 aa, Lactobacillus casei
MKKQTSVTVTFDAAIKARLDAYCELNDTDTQDVITTAVAKFLQSQAPDINQLISGYVAMGQINTEISHAFSACESEAYAHIR

SEQ ID NO: 8257 - protein, 379 aa, Lactobacillus casei
VTIGNFRPATVLIDETAILHNVQHEVARLKKKTQLFAVVKADAYGHGMLRVARVAKAAGASGFCVALLDEALDLRDANFVEPILVLGIVPSQYAALAAAQTISLPISSVEWLEQALPVLEAQPELPPLRIHLALDTGMGRIGFTEDQALLDALRFIQEHPKQFTVEGIFTHFATADDPDDAYFKQQVAKFNHMVDLLPTRPRYVHVSNSATSLWHAACNGNMIRYGVAIYGLNPSGDAIPTTPFPLEPALSLESELTYCKQVHAGDGISYGVTYRAKGDEFIGTVPIGYADGWLRRLQGFHVLVDGHACEIVGRICMDQFMIRLPKAYPAGTKVVLIGQSGDQEITLLDVAKYSNTIHYEIACNLTPRLKRQSINSIGE

SEQ ID NO: 8258 - protein, 124 aa, Lactobacillus casei
MIYGIGVDVTDLGRIQAAQEKNHGFAAKILTPVELANYQQLDGRRAVEYLSGRFSAKESYSKAFGTGLGKVALQDVEILNNELGKPILTKHPFSGNAFVSISHSETLVFTEVILEKEGPERDDR

SEQ ID NO: 8259 - protein, 536 aa, Lactobacillus casei
  misc_feature (6)..(6): Xaa can be any naturally occurring amino acid
DEADBXATPDEPENDENTRNAHELICASECSHALKFKELGLDHDLLKAIAQSGFEEATPIQAETIPLVLEGKDVIGQAQTGTGKTAAFGLPILQHIDKADRSIQALVISPTRELAIQTQEELYRLGRDKKIKVQAVYGGADIRRQIRQLADHPQIVVGTPGRILDHIGRHTLKLEHLDTLVLDEADEMLDMGFIDDIEKIVEQMPTERQTLLFSATMPAAIMRLTNKFMKSPVVVKIKAKELTADTVEQYYVRAKDYEKFDVMTRLFDVQDPDLALIFGRTKRRVDELTRGLKARGYRAEGIHGDLTQQKRMSVLRQFKSGQLDFLVATDVAARGLDISGVTHVYNYDIPQDPDSYVHRIGRTGRAGHKGVSVTFVTPNEIEYLHTIEDLTKKRMLPMKPPTAEEALMGQISSGLSTIKEQVEANDTEKYEAMAETLLENYTPLQLVSAYLKAVSPDDASAVPVKITPERPLPHRGRNNHGHGNNRGGGYKGGYKGKRREGGYQGNRDGRRNYDKKRNFGDKRKNVKRNFKIRSGE

SEQ ID NO: 8260 - protein, 463 aa, Lactobacillus casei
MMKMTLAEIARVVKAQPLSEADGSRVVTGLTFDSRRLKPGMLFVPLQGERDGHEFIPAAAAAGAVATFVAANHAPIKTKLPALVVSDPLTAMQQLAQYYLLMKVNPKVVAITGSNGKTTTKDMTAAILATQYHVVKTPDNYNNEIGVPMTILSMEPNTEVLVLEMGMDHPGQLHALSSLAEPDVAVITMIGEAHIEFFKTRAKIADAKMEIIDGLKEDGTFIYNGDEPLLVERAKKVTQKQETFGLHPENTLFAHSINGHRNHTEFTVEQWPDLTFSIPIMGEYNVVNALAALLVGRQFHVKPEVMQKALAHFQVTANRTQWLIGDAGEQILSDVYNANPTAMRAVIRDFSEFTATGRHIAVLGDMLELGDQSQALHAGLADALDPHEVQVVYLYGSEMHALADALADKYSPDNLHYYPLSAKDQMIRDLQNDVGHDDMVLLKASHGLHLETVLGALIAGGHA

SEQ ID NO: 8261 - protein, 252 aa, Lactobacillus casei
MRNAMIYVHHEPLAHLFLTYGISASDLLNSQQKIPNHLLLLPPVNEQEQIDPHTWFNIINGRDQVREFLRSKEGQTRCWLDYARPRFLQELTPNEIAELLYLGHVKTHLSSPFYYKLQNELVYLPLRNGMVNMYLRHEALFEAFLAAAINKYLRRIANEQPFWLRLRQQHFSPLSDEAYTQLFPLMEDGVLFDFRNVRFSREQIRIPLLEPSNRFIPDSAFPDNTVRKLGKLVLMRQKNQWQMVPTETAKKA

SEQ ID NO: 8262 - protein, 213 aa, Lactobacillus casei
MLPWPNKIPQPNLPTVPHTDLIPSTYFSTIKTGYLPKRWWLPTSEPTSDGLDGVGIHAFATPGAAITADDLPADFLPFAHTGHQYFGFDLSHDPRRIRYIDTEVDQWLTIAPDFDTFLKQLQPHPVRLPELPVDPQVFGHMAVIATAADWPALFDHARTFMTGAELGPWLVWLATSDESAKRQAAAEEYHFLSRYQPNFLTPNTTIELRKLLS

SEQ ID NO: 8263 - protein, 225 aa, Lactobacillus casei
MTKRSNFLYWLNIGGDLLYLLIVGGLFISGRPLFHGQAMLLAQVASGILIVSLPRLMEHWWHFRFPPLLIYLFEIFILLSVLLGTGLQCYSVPYWDKFEHLFSAAMLAGLGFAIFAALTPAKRLATTSPLLMALFALAFGTTIGVLWEFYEFTFDGLLGMNMQRYMAASGVLLRGRAALMDTMGDLFMDFFGSLGLALFGYFGIKRDLRWLDTFKFQSEDRGKRQ

SEQ ID NO: 8264 - protein, 142 aa, Lactobacillus casei
MPIKTLPEDQLVAMSQSVVKEVAQAFAFPYYVNDLTHDANFDTDHTATKLEFELTLLNDPDPDRTISFYSDADADPIMGGAASAQVVVTAGITFIYLNDGYKDSYLIIIHDGKVVQNLKLEQQILSGPEVEDLIEHVIPNAK

SEQ ID NO: 8265 - protein, 83 aa, Lactobacillus casei
MKQGIHPDYHPVVFMDSATGFKFISGSTKTSKETIKWEDGKEYPLVRVEISSDSHPFYTGKQKFTQADGRVDRFNKKYGLDKK

SEQ ID NO: 8266 - protein, 419 aa, Lactobacillus casei
MEKMLIHGGKKLSGEVVIGGAKNSTVALIPAAILSRTPVTLDSVPHIQDVYNLMAILDDMNVKSDFTENVLTIDPTEIHDVPLPNGKIKSLRASYYFMGALLGRFGKAIVGLPGGDDIGPRPIDQHIKGFEALGASVSNEHGAMAIKAPAEGLHGARIFLDMVSVGATINVILAAVTAKGRTVIENAAKEPEIIDLATYLNNMGAKVRGAGTDVIRISGVPTLQAHNSHTIIPDRIEAGTYLAMAAAVGEGVKVKNIISEHLDAFLAKLEEMGVVMDVGEDSIFVYPSGDLKMVQIKTMPYPGFATDLQQPITPLMLKAHGEGLIIDTIYPKRVRHIPELLRMGADITIENDVIILHHCDHLQGTEVAAEEIRAGACLMIAGLMAEGTTTITKVDNILRGYDRVVMKLRGLGADVELVD

SEQ ID NO: 8267 - protein, 48 aa, Lactobacillus casei
MGLPTRNRVLYLKQKMQVSFSLLEMNDLKRGFKSNGKNADPRRKEIVR

SEQ ID NO: 8268 - protein, 534 aa, Lactobacillus casei
MTKYIFVTGGVVSSLGKGIVAASLGRLLKNRGLKITIQKFDPYINVDPGTMNPYQHGEVFVTDDGAETDLDLGHYERFIDINLNKYSNVTTGKIYSEVLQRERRGEYLGATVQVIPHITNMIKEKIMRAAKHSDSDVIITEIGGTVGDIESLPFLEAIRQMKRDVGSDNVFYIHASLVPYLRAADEMKTKPTQHSVKELRSIGIQPNMLVVRTEKPITEDMKKKIALFTDVPENAVIESRDAKTLYSVPLALQAQKMDQIVVDHFGFDVPAADMAEWMKLEHKVQHLTHHTKIALVGKYVALKDAYISVAEALKHAGYYWDSDIDLEMFQAEDVNDDNVESLLQGFDGILVPGGFGDRGLEGKIAAIRYARENDIPFLGICLGMQMASIEFARNVLGLKGAGTTETHPDVKDPVIDLMRDQVGVKNLGGTLRLGLYPCVLKPGSVAAKAYDNVHEIQKRHRHRYEFNTKYRKPMEDKGLVFSGVSPDNRLMEIIEYPKNKFFVASQYHPEFQSRPNKPEGLFKAFIQSAGDFKN

SEQ ID NO: 8269 - protein, 227 aa, Lactobacillus casei
VYRLKLKAFANADKSELSMIEVAHEILEEKGDTMAFVDLANEIQTYLGKSDEEIRERLPQFYTDLNVDGSFISLGDNVWGLRAWYPYDSVDEEVNHPEDEEEVPRRKKRKKVNAFLADVADDDDVIDYNDDDPEDEDLDADNDDDDFDDDDHTGFHDKIGKAAATDDDSDDDPDDGLPDGIEGQLAEFGDNDSDDDDDNDDITADFSGDDDSDDDDSDDDDSDSDKH

SEQ ID NO: 8270 - protein, 148 aa, Lactobacillus casei
MDLSQGVPIQIHLETFVTQGDDTETHVFDEPGTLVQMGNALYIRYQEVDEDAGTSMPVTMKLRDDGDIQLSRGSSNGDTQLKLFFANEKRVLTRYRTPYGIIPVETVTPRIDARMTTDPVAGEIYVEYELFANHQHLGNYRLRLQFKA

SEQ ID NO: 8271 - protein, 274 aa, Lactobacillus casei
MDLTSLAGQQAAIFQQDFTKEEAPLSFAHTNALLAHPELHPPLMLHFWTAEQTVILGMQDLKLPQFGHALPVLASDHYGVFVRNSGGLAVIADSGVLNVSLFLPNEDNLSIDTAYNMMTALFRTAFPSLPIATSEIIHSYCPGKYDLSVHGRKFAGMAQRRNHAGVVVMLYCSIFGDQNARCELLRRFYRAGHASTSTHFKFPIIRSETMTTLSDLLGRPLTRNEAILALLNALAANGIAADMNSMPAILRDPAYHKALAAATADLRNRNRHLS

SEQ ID NO: 8272 - protein, 450 aa, Lactobacillus casei
MQFEKLPREKVFRDPVHNYIHVQHRVILDLINTPEFQRLRRIKQLGVSDYVFQGAEHTRFAHSLGVYEIAREMCDNFVTNYPSKTPEDGLWDDRERPVVLCAALLHDIGHGAYSHTFEHIFNTDHEAITRAILTDPHTNVNRILRSVSSDFPERVASVINHTYPNPQVVQMISSQIDADRMDYLLHDAYYTGTKYGLFDLSRILRVMRPYSDGIAYEANGMHAVEDYVVSRFQMYQQVYFHPVSRGMEVILSHLLKRAKFLYESGQFEPGFSPRLLVPFFEQSFSLSDYLKLDDGVLNTYFTYWLDYPDSILSDFADRFLNRRPLKSVTFTDQTAELLPKLRHLVTEAGFDAQYYTAENDSFDLPYDQYDPASANPKTQIEIMQKDGTLEELSTLSPLVAALSGRATGDKRFYFPKEMLATEDSNLFSSIYEKFQRYLLNGGVIDPHLHD

SEQ ID NO: 8273 - protein, 150 aa, Lactobacillus casei
MIDPVFGRKDPKLDYHTRIGAYGVIPDHSGARLLILQAPNHALFLPGGGVEKGETPEATLARELLEEFGATVHVTKELGKSSEYFYSHHRQTAYYHPATFFACDELAFVQDPLETFNTLMLMPIDLALAELKRPTHRWAVAKWLAQQPKR

SEQ ID NO: 8274 - protein, 349 aa, Lactobacillus casei
MTVQETLFVFSIPIVLGIIFAISFTVEPRRLINGWLFNLFAVAFLFALALAILGSSNLLLIAVTGTLFVITVLIVILIFTLHLFWLLWNAILVWRREGHSLSNMLTLYIAIGLLLLEIAASFGRRFIPEPIYITLAVFFSFGGLYVLLTLYNFLTVLVLYNLRPQPHNRTFLIVLGAGLLHGDQVSPLLASRIDTAIKFYHKQIKKGRPAPRIIFSGGKGGDETISEALAMQRYALGKGIPEKDTLLEDKSTTTLENMTFSKRLITQEIGEAPYKASFFTNNYHLFRAGIYARMAGIDANGVGGNTSFYFLPNAVIREYLALVVLYKRRHAVAFGIIVFMALAQLLRAW

SEQ ID NO: 8275 - protein, 126 aa, Lactobacillus casei
MLKEFQKFIMRGNVLDLAVGVIIGSAFTGLVKSLTKNLINPILSMFAGKTDLSGLSFTLLGAKFTYGNFLNDVINFLIIAFVVFLIVRSVNRFLPAKPVKPAGPTQTELLEEIRDLLKDQDAKAKN

SEQ ID NO: 8276 - protein, 141 aa, Lactobacillus casei
MQKRIRLFAAYALLTLFFHLKKKNGLNFGLTLGDVYLLVSWLGAAPNFLDKIERNVQRLAATGRSTKDYVAEMKKDMNVYQNFIYSTTPVMASILESGGMDRVGAVIVRFTFQLFLVLTAPVIWIGALLSKWLKYVWRRLN

SEQ ID NO: 8277 - protein, 124 aa, Lactobacillus casei
ASCHDMAINPRTEINMKMGLMHDQFELVREGSKTIEIRLNDQKRQQVRVGDPIVFEDLTTQQKMSKRVAKLEKFASFAQLYDHYQGIVVGSAPTDSVAKMVSDTYRIYSKQQEAKHGVLAIHLE

SEQ ID NO: 8278 - protein, 392 aa, Lactobacillus casei
MATTFTNCSLFTGTSEKILKDAWFTVDDTGKVAEVGSGQAPSANKTVDLGGQYVTPGLTNVHTHITMDPLTGDGGTSRGVVASTVGAVDHLHQLLKSGVTYVRECGSSFDIDIALKALKDQGQLKQVPQIMPSGKFFSMTGGHGDMPNAAYVVDSPDEMRKAVRTALKKGAKAIKVIATGGVMTPNDFMDDPQLSVAEMHVAVEEAHHKGQIVAAHAEGNPGIMNAIQAGVDSVEHGFYVNDEEIDLMLKQGTYLTPTLVADWAIPTFAKGKIPDWEVKKAADALDDLYKNIMHAFHRGVPLTLGTDAGTPFNDFTMAPVELQLMVEQGMTPFEAFSTSVNGTKLMGVDDQYGTLEKGKFADFLVLENDPMADVKAFQQKDKQVYQGGKRQY

SEQ ID NO: 8279 - protein, 449 aa, Lactobacillus casei
MNEQKSIEEFALSYLPSLEDYLRIPTISAQNKGIRKTVDWVKQAFKDLNADTVEEWTDQGGNPVVFAELKGNSDQTVLFYNHYDVQPPEPLAEWRTEPFEPTVVDGKLIARGVADDKGELMYRLTALRWMKDHGGFPVNIKFFIEGGEEVGSPHVGDYVKAHRDRLTADACIWETGGKNEADHFQIIAGLKGIVSFDLHVKTADADIHSSLAAYIDNAAWRLVRALSSLTDDQHRVLVDGFYDGIEPLDEASEKAIADMDFDGDKIKKTYGLKRPFTSDDPKRAIVTAPTITINGLSAGYEGEGVKTIIPKEAKAKLDCRLLPGQDPKKIAQLIQAQLDKNGFSDVRLHYNLGEDAFHSDLNDPHLQLAKSVAEQVYGAGKVRFVPMMPGGGPAKFFVDALHLPVILIGVNYAGSGPHAPNENIRLHDYQQGVAYLIQLLRTYAQPKAQ

SEQ ID NO: 8280 - protein, 396 aa, Lactobacillus casei
MNFLIAFTVVMVFMTVGEWVAAATRAFIPSVFITAVLFVIGFWTVLPKNVVATASFGSGFITICIALLLVHLGTLMNLRELLAQWKAVCIALLGVCGTLLLTLTLGTLIFDWKTVVAAVPPLTGGLVSALLMSSGLKAQGLTTLVALPVAMFVIHSVVGYPLTSVLLKQESHRLLKQFRANGSKLDPSIPKMRRGAEEKGDNRPKMMKLPTPYQTSAFIMARVAIVGVLAMGFGTLTHNVINSNVVCLIFGVIAHQIGFLEDNALNKAGVFNWLMYGLLAYVFGQLSATTPAVLASIVLQIAVLIVLGVLGMFLASRVLAKPFGMSWQMAFSCSLTALFGFPADYILTSEVASAVATTEDEEEYLTQQMMPKMLVGGFATVSVASVIIATIFLKLL

SEQ ID NO: 8281 - protein, 324 aa, Lactobacillus casei; identical to SEQ ID NO: 610

SEQ ID NO: 8282 - protein, 462 aa, Lactobacillus casei
MSKKFTIILAAGKGTRMKSKYYKVLQPVCGKSMVEHVVSQVEAIHPDAIVTIVGHGAEAVEKTLGDRTKFVLQEEQLGTGHAVLQAEPLLGQKDGATLIISGDTPLFTAKTLNDLFAYHEAKGAKATILTANAPDPTGYGRIIRDADGNVIKNVEQKDATPEEALISEINTGVYVFDNQSLFKALHSVKNNNAQGEYYLPDVLGILREAGEKVAAYQMPDYTESLGVNDRVALAKATRIMQQRINEQHMRNGVTLIDPATTYIDSDVQIGADTVIEPGVYLKGKTVIGEDCHIGTHSELVDATLENDVTVTSSTIEHAIMHAHSDIGPNSHLRPDADIGEYVHLGNFVEIKKAKIGARTKVGHLTYVGNATLGTDINVGCGVVFVNYDGVKKWESTIGDHAFIGSNSNIVAPVEVADHSFIAAGSTITKDVPFHAMAIARARQTTKEDYWKRLPVANDPDWN

SEQ ID NO: 8283 - protein, 390 aa, Lactobacillus casei
MSAYLGPVKTALITFPFLALVLALPFLVIVYRRYGAFSWWRAIVIYSFIFYLLSAYFLIILPLPSREAVAQFTGPKYNLTPFMALRYFIHTTVFSPTNPHTWLAALKQSAFIQPFFNVVLTIPFGFYLRYYFKRTVPQIIMMSFGLSLFFELTQLSGLYGIYVRPYRLFDVDDLILNTTGGLIGGVLAPIFMRALPSRDTMDAKSQARGVRVTLMRRLVAFFIDFIILSTIVGLMIRFLFHLLGLAQLPDFLSEVVLPLLFVFVIWPAFNDGQTLGKGLVRIKIVRTDGRPVGFWRLLLREALLYGLAYSSLIGASNFLIEYFALGHQTEINLAALGFFGIISILVVLNFIWETVTRHYRFFYDAWADTTQISTLKVPNDVKQHAAENEQ

SEQ ID NO: 8284 - protein, 282 aa, Lactobacillus casei
MKVRRSDRLIDMTRYLLERPHTLIPLTFFSKRYESAKSSISEDLAIVRRTFAQRQTGILETVPGAAGGVRYIPIMGEDEAENFISAMAKRLSETDRLLPGGYVYLSDLLGTPSVLRQIGRLIATQYRDAKVDAVMTVATKGIPIAQSVSQYLNVPFVIVRRDSKITEGSTVSVNYVSGSSARIEKMELSKRSLPANSRVLIVDDFMKGGGTVNGMKALIDEFNAEMVGITVFAEGKFDGDRMVNEYTSLIRVDKVDTKANTLHATAGNFLSQNQQLLEVSHQ

SEQ ID NO: 8285 - protein, 216 aa, Lactobacillus casei
MNAFELHHMTFAPTKTAILNDINLDIPWGIDLTIAGHSGSGKSTLLRLLATLLTPTSGTILYNDKPQSDYDPILYRREVSYCAQQPALFGATVADDLRFPFAIRNTEMPREQAEAALESVDLAKSMLDAPTQNLSGGERQRVALLRHLFFPPKVLLLDEVTTGLDPDTKAVIHDLLDRQNKKGITLVSVTHDEGELHMAKNLMTLVDGQFEEVPTA

SEQ ID NO: 8286 - protein, 253 aa, Lactobacillus casei
MNSQLIVSPLALLLALILVVIALTINLKEELGMTKDLIVGVVRAVIQLTVVGFVLTYIIKVNAVWLTLAMVAIIIFNAAWNAKKRAGTIPDAFVTSLLAVTTATGLTLIMLVSVRAIRFIPAQIVPISGMIASNVMVATGLAYRSLNTEFTDLRPQVLERLALGATLKQASQKLIVNAIKTGMAPTIDSAKTVGLVSLPGMMSGLIFAGIDPTKAIMYQIMVTFMLLGATSLGSFIAVYRSYSRFYNEQKQLR

SEQ ID NO: 8287 - protein, 292 aa, Lactobacillus casei
MEQVQPNKAFFWGILLNLVYIIAEIAFGIGIGSVALVADAIHNMSDVLGLGLAWFAEWLSNRHPTVQRTYGYKSSSILAALANAAFLLVAMGAIIVEAITRLSQNAPVEGGWMMLVAGVGILVNGATAVLFHSGSQHDLNIRGAFMHMAADAGVSLGVVLAGGLIMLTGWEWLDPVMSIVVAIVVLVGTWNLLRDAVNLAMAAVPKEIDPIAVKTLVNAYPTVASCHDLHIWALSTTDVALTVHVVRTTPEGNDAFLDALSLSLRESFDIAHTTIQVEYGPYLPDNKMENPY

SEQ ID NO: 8288 - protein, 292 aa, Lactobacillus casei
MELIEKAPAKINLSLDALYRHADGEHEWQMVMTSVDLADYVTIQPSRTIKVSTDSGFLPEDPRNLAYKAALALQRHANIRQGARIHIEKHIPVAAGLGGGSSDAAAVLRGLNSLWELGYSRSQLARIGLSVDSDVPYCVYSETSLVTGRGDVVTPLGSLPNFWVVLAKPRVSVSTPTILNAIDYQAGLEHPDTQRVVAGIQNHDFNQMISGMGNTLEKITASRYPEMTALKHRLEKYGAEIAQMSGSGPTVFGLCQKHSRAMRVYNSMKGFCREVYLLRPFCLPANGRGLRG

SEQ ID NO: 8289 - protein, 83 aa, Lactobacillus casei
MPITLASIKRKLDGKIGENLTVVAQAGRKKVTRRRGTLKETYPAIFVVDLDQSENAFERVSYSYADLLTKSIKITFEGEEKAS

SEQ ID NO: 8290 - protein, 298 aa, Lactobacillus casei
MTMREKVAQPAVTNAILKRHGFRMRKGLGQNFLTDPQILQKIVAAADLSSQDDVIEIGPGIGALTQFLAESAHQVVALEIDERLLPILAETLADYPNTAVVNEDVLKTDLSALVAEHFDGKHTLKVVANLPYYITTPILLHLLRARLPLHSMTVMMQKEVAARLSAAPGSKDYGSLSIAVQLVADVTTAFTVSRHAFVPAPNVDSAIVTLTQRSEPLADVTNPDSFDRLVRGAFASRRKTLWNNLVALFGKENRPAIRKALAAANIAPETRAEQLAIADFARLDTALRGEGLGVRADA

SEQ ID NO: 8291 - protein, 189 aa, Lactobacillus casei
MTTIKQIVVVEGRDDTKRLKETFGDIDTIETRGSAIDDATLARIRQAQAKRGVIVLTDPDFPGEKIRKTISRAVPGVTHAFLPRAEGVPAHKGSLGIEHATPAALRAALQHLFTEVPDAPQIISQQDLLAAHLIGGDGSRHRREQLGELLHIGYTNGKQLLRRLTEFRISRAAFFAALDQVNGGQDDHA

SEQ ID NO: 8292 - protein, 259 aa, Lactobacillus casei
MNIFDSHTHLNDTPYRGKEADYIEAARQLGVKKMAIVGSDTALNAGALKLAHEYPNLYAIVGWHPESSQNYDAAKEALLLKQLADPKVVALGEIGLDYHWDTSPREIQRRVFRRQLELAHSLHMPVSIHSRDAFEDTYDILKAAHVEQFGAIMHSFTGDAEWARHFLDLGLYISYSGIVSFKNAPEEHASAKIIPSDRLLVETDAPYLTPTPYRGRQNQPGYTRYVVEALAKLRDTTPDVIAQQTWDNAHRIFRLKEDA

SEQ ID NO: 8293 - protein, 164 aa, Lactobacillus casei
LAEFSTTPLVYFLNTPTQEDFFNVISHELVAQKVMLPAGKAALIAREQTFPSGMQLNQIADRLPNIAIPHLEGDLVQQGRLVVVHFEIPIAFKDLADVSRILPVEWAFMLMNPVAKEQPMRIAQLIRALTQSPVAQLQHLFAAKKPSQVIRLLPPLMAEAERKQ

SEQ ID NO: 8294 - protein, 332 aa, Lactobacillus casei
MSVKLTAGQLAHLKQLSNDDNVISALAIDQRGSLKKMLAAAANKPADETTIVDFKKAVSEELTKYASAILLDPEYGLPAAKVRDPKSGLLLSYEKTGYDATEPGRFPDLIDNQSALRIKNEGGDAVKFLLYIDPDEPDSINDRKYAFVERVGAEAKANDLPLFLELVSYDGKTNETGTAAWAKAKPEKVIKITKEFSKPQYNVSVLKLEVPVDQKFVEGYTDEGVTPVYSKEEAAKYYKAQSDATDLPFIFLSAGVSNELFLEELKFAKEAGSTFNGVLCGRATWKPGVKPFAAEGEAAGKKWLETDGKANIDRLNKVLAETATPWTDKVEG

SEQ ID NO: 8295 - protein, 293 aa, Lactobacillus casei
LITIENNQFKAGIAERGAELQSLVNKSDNYEYIWNGDKTFWNRHAPILFPAIGKSNEDQYRLGAKTFPMSQHGFARDYDFDVSDKSDSAVTFTQHQSAETLKKFPFKYTLAVTYMLTKDGLSIHYTVTNDDKDSMPFALGFHPAFNVALKADGSFDDYDLTVEPLNSPLQRFGIGPVPFRNGDVEDIPGAEGNKLPLTHELLDGGLVILANSEIMKATLSSPHHDHSVTLDINDFPYLTIWSPEHKKAPFIAVEPFDGLPDQAGEPSDWYTKLGNTTLSAGANKQLALKIALK

SEQ ID NO: 8296 - protein, 234 aa, Lactobacillus casei
MHIALIDDQAATREATVKMIQQLAQPSQPLQVAAYASAEQFLFAEQTPDLLLLDIKLGSGMDGMSLAKKIRQHDPDTAIAFVSNYDEFVFDGYDVNAIDYIIKPLTKEKLQHLIDKTAARTQPKLLPLQTPNGLTRVPLYDISAIEVTDHRLQVHTQKTTYTVSGQLKDLLPRLDDNFIQIYRSIVINLNFLSQLDHHTVVMADGTTYPVSRQQAPVVKQAFFKHFRGLTDDSE

SEQ ID NO: 8297 - protein, 303 aa, Lactobacillus casei
MTVNDWIGLGAFLLLTVGCCWQLWWIFRRQQNWPVRWLNLAIVAVALGSWWLWPQPIVRVLLFVGTVLAGSLEFVLIRQFLSDQDAVFARSLDKMMAQYSQEVQELYANMRGWRHDYHDHLQALKAYLDNQDTTGARQYLDELEDKLDAVDPLVHSGNAMLDAIVNAKLTLAERLQIPVNEKVIVGNTPLIKDVDLVVILGNLLDNAIEAITEQPADEKRQLRLYIGIVKQQFYISVTNTRPADQVIDYQYASTKSDKRGLGIRRVNKLVAKYDGMINRQYEDEVFVTEIAIPIHAVKPTTHA

SEQ ID NO: 8298 - protein, 608 aa, Lactobacillus casei
MKKYSLWNNLRWYIKYLRKDKPSLAWTASGLAIDKAAAALLGVFTPALLVGAITGHATLDQFAWLATLTGLGLALTSEIEYLLLTHDSVSSSVLRGVIEMDFHQKQWDLDYDQISSGKLQGLAHTAFEKGLSNTYAGAEAIYLYGRGTLVDLTTLIVFLATLSFAVPWVFALVLVSAAISYAGMSWYRHWYQQNNVKWNKLGRQQDYITRNAYALENGKDIRMFGMANWYHHHLDRLIQLQDAWQRRNSLRRFLGEQIGQLAGLLRDAIVYGTLIVAIMRGSLSIAQFTLMFGMTNSFITLLDQLLDDFGKLQNASLDLQELRDFMKLQPQTPTRTLTEAEQKQLAKRPVTITFSHVTYQYPGAKSASLKDVSFTLQAGKKLAIVGINGAGKSTLARLMMGLLHPTSGTITINGLNANLLPLAERFALFAPVFQETIILAQSLANNVAMTEHPDLNRVTTALTEAGLGAFVKTLPQTTATPMTRYTRDDGVELSGGQAQKLMLARALYKDAPVLILDEPTAALDAIAENEIYQDYAQLAAGKTSLFISHRLASTRFCDSILFMDHGQVLESGTHEQLMAKGGRYAQMYQIQSKYYQPDAKEVAVNDNF

SEQ ID NO: 8299 - protein, 637 aa, Lactobacillus casei
MTTSKDSEKTMPKQTVHRALRVVRVIQSLDPLAIPVEFLRALTTVGIPYLNIAFLGLVLNQLQQRATFRRMVLLVGLFLAIRYLLQLSSQWFAKLAEDHESGVNRRLTRVTTEKLLTVSYTTLQDPDMRKQYAGAQAGQTFNGGMTSLMTNGMQDFFSLIIAIGFGVATLISLARATNHVTTWLNDFRYPLLILALLIFPIVVGSWSIHHSNQIQQELIRKIIPSNRRFTYFYHFTENMDNHEVIRLYQASHLVMNNERNDNNEFFGQLSHGYWQMAKFGHWPNLAIALSVIGLYILVGAKALMGIIAIGSIMIAVGYFQQLMTAAYQFLQQVGMYINMVDYLQFYADFLALPDHDKSGTLPVEKRNDNEFAIQFHDVSFKYPGSDQWALRHVSLTLNIGERLALVGRNGSGKTTLIKLLVRLFKPTEGTITLNDIDIQKYDEDEYRSLLGVVFQDFRLFAYSIAENVAATTDPDRARVWEALKVADVADRVKRMPKTIDTPITTALSDDGVTVSGGEAQKIAIARAWYKDAPIMILDEPTAALDPISEYEIYQRFDELIEGKTAIYVSHRMSSTRFSQRIVVLDHGQIVQDGTHTSLMAHPGIYRELFNAQAQYYTEDRIKAARKKVAATTTAVAD

SEQ ID NO: 8300 - protein, 660 aa, Lactobacillus casei
MASKPTFYVTTPIYYPSGKLHIGNAYTTIAADVLARYKRLMGYDVFFLTGTDEHGLKIEQKADKLGVTPQAYVDGMAAQIKQLWKTLEITNDKFIRTTDKAHVEAVQTIVERLIKQGDVYLGEYTGWYSVEDEEYFTESQLSEVYRDKDGNVVGGKAPSGHEVQLVHEPSYFFKMSKYTDRLLKYYDEHPDFVQPASRKTEMINNFIKPGLEDLAMSRTSFNWGVQIPSDPKHVVYVWVDALLNYITALGYGSNDHALFDKYWPANVQLIGKEIVRFHIIYWPIILMALGLPLPKKIYAHGWLVMRDGKMSKSKGNAVYPDMIVERYGLDALRYYLMRAIPFGNDGLFTPEDFIDRINYDLANDLGNLLNRTIAMINKYEDGILPAFKPDVTPFDKELGDVAEAALTEYHKLMDELRFSDALDQVWKIVSRANKYIDETEPWKLAKDPAKKDQLDSVMAHLAESLRLIALLIQPVMTHAPLQIFGQLGLDHENDDHKIVKWGALPAGAKVVEQGTPIFPRLDAEEEVAYIKSQMTPGTAKAAVDDKTRKSEIEFKQFDKSEIRVAEILDVEPVKGADKLLKFTLDAGDKGTRQILSGIREFYPDYEKLKGKKVMAVVNLKPRKMKGEISEGMLLSAESLDGKKITLLEVSENLQNGSLVG

SEQ ID NO: 8301 - protein, 292 aa, Lactobacillus casei
MKIIEGYMPFHEYKTYYRIVGEPSADKAPLLLIHGGPGSSHNYFELMDDYAATGRQLIMYDQVGCGKSSLPEDPAVYVKETWAEELIALRKFLHLDEIHMLGQSWGGMLEMYYLTSFDPQGIKSVMIDGSPASIKLWVQEQHRLIKYLSYEDQEAIAEAERTGDFKNVKYLAANDRYMEKYCWDDPDENSPEPLRRPTNGKRASLIAEGPNEFTENGTISDFDVTDQLHKIHVPVLVTSGTDDLCTPLIAKTVVDHIPGAKWHLFANSRHLALLDQHDEFIDVLDHWLAAND

SEQ ID NO: 8302 - protein, 270 aa, Lactobacillus casei
MINVGLTSVADHPSIAANGKRSTFADYAQYFPVIELDTTFYGLKTVEQIRRWQAQVPASFQFIVKASKLMTKHEATQDLVAEFSRFNDMVAPLVAAHQLQAVLCQFPPYFGVTAENVRYLQNLNQWLPDLPVAVEFRHASWYLPAYRDATIGLLQAAGDIHVVVDEAQTVGGSVPLVPIATNPDLTILRLHGRNQAWGQSGAKTTERTNYRYSQAELQQFATIVHHLKSKNVTVIFNNNGGHDAAANTQAFIDMLGLDFPGLAPRQLDLF

SEQ ID NO: 8303 - protein, 174 aa, Lactobacillus casei
  misc_feature (4)..(4): Xaa can be any naturally occurring amino acid
NDIXDMAINPRTEINMVKKYTLVTVETPTGWLLINRTNPPYRGMWNTLGGKFLPDETPAVCAARELQEESHIIIPANELRSVGRVFWHVDGELRGELYAFLGKTPDRLQMPQATREGILATFSKEWLLADNPGLVPDLQPLLRYALNGEKHDYASYFTGDVLQKFQITDGERHD

SEQ ID NO: 8304 - protein, 301 aa, Lactobacillus casei
MARTIGIIGIGHVGVTTAFNLVSKGVADKLVLIDQKAELAEGESYDLKDALGGLPTYTDIVVNDYDALKDADVVISAVGNIGAISNGDRIGETKTSKAALDDVAPKLKASGFHGVLLDITNPCDAVTSYWQYLLDLPKSQIIGTGTSLDTYRMRRAVAETLHVNVADVRGYNMGEHGESQFTAWSTVRVNNEPIAEYAKVDYDQLADAARAGGWKIYNAKHYTSYGIATIATEMTQAIISDAKRIFPCANYDPEFGIAIGYPATIGKLGVVNTPELKLTDDERAKYVHSAGIIKDTLEKMK

SEQ ID NO: 8305 - protein, 198 aa, Lactobacillus casei
VSKGRLEAFTDAVIAIILTILVLELNPPHSGSLASLWALRGRFGIYLVSFLTLIVYWNNHHHLFQLVNRIDWRVMWANSFFMLAISMFPFATSWVGEGHVNAFGPELIYGFVVLMSNVSYLLLVVTLRHVNGPTSALVKLYGHQHDWKAVGSIIMAFIAMILALLWPPLTIILDLLMLLLWAIPDQRVERHLLRGPKE

SEQ ID NO: 8306 - protein, 230 aa, Lactobacillus casei
MFDLQTAIDQAKRVTFMTGAGVSTASGIPDYRSKGGLYADKVDPEYALSIDNLQAHHEDFHKFVVENMYYPDAKPNVIHEKMAAITNQKGTIVTQNVDGLDRKAGAKHVVEFHGNLYRIYCQICRKQFDYQTYLKSDVHEADGGILRPDIVLYGEPINPDTVSAAINAIAQADLLIVVGTSFVVYPFAGLIGYAQPDATIVAVNRERIALPEGAQMVLGDAVDVFAKLHV

SEQ ID NO: 8307 - protein, 31 aa, Lactobacillus casei
MPAKINEEAVSHGLNTKHHNLVEDEKEENED

SEQ ID NO: 8308 - protein, 308 aa, Lactobacillus casei
MQKDVQALLDEVKSHYDHPLEVAINGEASGVLTHDQSHQRLKKDGTLEVVVTDTTNVAYTLSHELLHLLFQMKGYPQLQFHLLSGDPQVDDQLYATSTALYNAAVHMLVVAWQREHGLLTDKVVAQVLAGFKQNVPAEADDQLVIYRILSLLDLLGFLDGQLPDELASAYPQALPYAQELFSLLDEQKLASPFGLRRAIVHLFERFDAQIEKLGYQPTNDHEFATVSPVLSKRQLRLTLDQVYLIKHSSYRDRDTKQPAYVAMGRSDDQNAFVLPLPEKETTPEAFQQLYQQPLDSVLTKYGLDFTIR

SEQ ID NO: 8309 - protein, 169 aa, Lactobacillus casei
MKLSVPLVNGMLADRYGKYATGADVKDGYPITSFPFTIEDAPEGTVSFALWLLDYDAVPVGGLPWIHWNAANIPANVTSIPVGASHSDQIPMVEGKNASAGHLVGNTDPFTQQGYVGPQPPDKNHDYTLMIFALDTKLPLQPGFWLNEARHAMKGHVLAKAEIDLPSRV

SEQ ID NO: 8310 - protein, 92 aa, Lactobacillus casei
MLPNILVSDQTGQSSHTLTGAITIGAIVAVIIILFLVIKLLGAILRHPFISLALFALGGFAIFKFALVGIIGIGVLAAVGAGALWMNTGDGG

SEQ ID NO: 8311 - protein, 326 aa, Lactobacillus casei
MKKLIKWLGLAAAGLALLTTAPRVVRADTWSQPVATLGASLTGDQKSGTLSTLQNAAGVSNASQLTVNGATLVKYLNPSGSSFTENSGVWSSALVQKTNNGGINVTIVPYNGTNNITTITADQYRNAALTAGVSNANLYITSAVKIDGSGALAGVYAAFAQNGDNLNNQQINAAQQEVNTLSSITQANKDKDGYSDKQLNNAVAGAKQEMATQSNNGQQTLSQNQIGNIVDSQLKQNNLTTIINNNQRQLIINLLVNVQKAGSLKNTDFKAQASKLANSIQNSAKGLFDKLNKSLNTEENRNFLQKIWDGIVSFFNGIAQWIRSQF

SEQ ID NO: 8312 - protein, 313 aa, Lactobacillus casei
MTHHFAVIDLGSNSARMTIWSIDQEVVKPVKRLKEMVRLSEDMGTSRTLQPAAMDRTLKALQGFKAELDKYEDISLKAVATAAVRQAKNQKAFLKRVKNEAGLTISVIPGTREAEYDFLGVVNTLPIQNALIMDTGGASTELVLVQNRKLQHLVSIPFGSVNLSERFLSPDVISAAEYFSLSTFIHQTFNSVWWLRRAQNLPIVALGGSNRTLAKIERRKEKLADFEAIHGYRMPTQQANNIFKEILSSDLATREAIPGLAKYRADIIVGGLVPVISMIRYLDSDRLTFSQFGLREGALYDHLNSRAVAQREH

SEQ ID NO: 8313 - protein, 721 aa, Lactobacillus casei
MKKLDFSKPRYFNNRELSWLAFNDRVLEEARDKNNPLLERVRFLGITQSNLDEFFNIRVASLKKMVTVNYDKPDAAGMKPQEQLDAISKTAHAMVEKQYNTLVRSLTPKLAAVDIQLLHPSDLNQKQRDFVSDYFHYELYPVLTPMGVDPTRPFPFLGNNSLNLAIRLVRPEDSEDDKSRSFAMVQVPDVFPRVLRLPGGDNVFILLEEVIRMFVGELFVGADIKETATFRVTRDMDMDVAEEDASDLMKEIQSQLKKRQRGKVMRLEIEAGMGKHLRKRLTKAMNVKDEDIYEIHGPIDLNFLSKLVKQVHGHKELLFKPFTPYMDPAFERESIFDVIKERDVFMQHPYDSFQPVIDFIREAAQDPQVLAVKMTLYRVSSKSPIIRYLKQAAENGKQVTVLVELKARFDEENNVHWAQELEHAGCHVIYGLVGLKTHCKLALVVRREEEGIKRYMHMATGNYNDVTARLYTDMGLFTCNNEIGEDASNIFNMLSGFSEPPYFHKLVIAPLGIRDYLMDRIDEEIAAAKAGRKALIQMKMNSLSDTAMIEKLYEASHAGVEIHLLVRGICNLKVGIPGVSDNITVHSIVGQLLEHSRIYYFYADGQENVYLSSADLMNRNLSRRVELLFPILQDDIRERIIKIFGIMWDDNVKTRVLQPDSTWTRVQLRGVTKLNAQAYFIKHAVAMGEALRREEIDQAPEDLHATHAFIPMTAPKEDDDA

SEQ ID NO: 8314 - protein, 509 aa, Lactobacillus casei
MANNIQGFAMIGAQSIVFSITNLRTLKTIERGKYPVAIGDDFYAEHEILPETVDTIVQAFDAINQIFKDYGVTTVNVYASTSWAEADNAEFVRDQLYTRTGWLIRTTSLSEEAFFRTQAIMVKFPQFASITQKGTVLIDISSGSVELTTFCQGTFGFSRNLSLGPLRVYEIMSDLQRSVTNYVEVMRDYIDSRLLDFMRLLPQGVEYTNMILMGSSLSIFQNLIPEGKRQVETDRPGFDMLYDEVTKASDQYLADTYDLTSSQTSLVLPTVLLVYRLIETLNSQSIWISDLKAIDGLEVHAAHAGGFKKLGFDPDEEIVISANNLAKRYQVDDKHMEATRTFALQLFDRLKKLHGMGKRERLLLEVAATVSDIGSYIETHKHYAHSNYIIMASEIMGLNELEVTMVATITRFHSSVTPQSDLKNFPMMSTENRLVVAKLSAILRVADSLDASRQQKIQQLRVSVKPNKVLLSAKVNDDIELERWTLARKGKFFSEVFGVGLELKGRNTL

SEQ ID NO: 8315 - protein, 61 aa, Lactobacillus casei
VTQYDHGLYKNMRLSPSFCAIANIFVIILDHHETTLKEVSLLTLINLRHSGKSDISCTFSL

SEQ ID NO: 8316 - protein, 274 aa, Lactobacillus casei
MKNHLDDITKLMALGPTADSYAVQRRQTAHRIAIADAWQVKAGENILEIGCGQGDLSAVLADRVGPSGHVTGIDIASRDYGAPLTLGQAWDHLLNGPLASRLTVHFNTNLTNGLGTLADQHFDRIVMAHSLWYFESANALALLLNNVRTIGDFVDVAEWSLQPTALNQIGHLQAAMVQGLLYAIAPSDVANIRTLITPDTLTQIAHDHTWTYTPGQLIENPDLDDARWEIATTSALLTELKLSTNLRDRVKPQLEAMHHNGTATLPTFTGRITF

SEQ ID NO: 8317 - protein, 164 aa, Lactobacillus casei
MIEFKPATTADLPKIVAIYNETIPTHRATADLQPQTVAQKSAWFAAHNTHFPAWVIQNHHETVGWLTLSAYSDRAAYDQTAEISLYLDQAARGHHVGTAALTFVDHEAPAHGLTTVIARIFGHNQASRHLFQKFGYELWGHLPAIATLPEGHADLEVYGKHFGI

SEQ ID NO: 8318 - protein, 451 aa, Lactobacillus casei
MRNLTIGKPLKLIVLFTIPLLIGNLFQQLYSFMDALIVGRTIGKDALAAVGATSSIVFLIIGFAQGTTAGLSILTAQAYGAHDYRRVRRSFGTSVWIALGISLILTVGAVTMTRPLLAVMQTPPDIMDDSIAFVRVIYFGIIASMVFNLLSNMLRALGDSRTPLIFLIIATIINIALDFWFILGFHSGVAGAGYATVSAQVIAALLCWVYIRMRIPLLVIRRRDLRIDWQDILRHLKVGLPMGFQMSIIAIGAVFLQVMLNTLGTNAVAAYTAAGRIDQLATLPSASFGVAMATFAAQNLGAKAYGRIRRGVYQTLIVNVGLSLGLGALIILFSKPLVNLFLGPNQPAVTALAQTYFHYNASMYWLLAILFTIRNLLQGLGQTLVPTVAGFFELGMRAFAAIFLVVPFGFAGASAANPLAWFGSVLVLVSSYVRTMRRIRQQEDTLAGEQE

SEQ ID NO: 8319 - protein, 286 aa, Lactobacillus casei
MRRHLAWLFAALTGLLLFAGAAHPVAAAEDLPARPTDHYYLDQDQYLDNNTKQLVDQKNRYYQGTKQQPQIAVAALKSTHGDPLSDYAPDLFQKWGIGKKGTDNGVLILYADNNGKQNLRIEVGYGLEGDLPDALAGQILDSNLKSIKSHNKADLNRALRKVFNAVATVIDKKYKFPKDQNTVPDETMNQYRSTGHSQGGSLLGKIILIFLAVVVVAVIFGGRGGGGRGGRRRDGDSGFWLWLIIDALLSAGRRGGGGGFGGGFGGGSGGGSSWGGGSSGGGGADV

SEQ ID NO: 8320 - protein, 202 aa, Lactobacillus casei
MKTKRLSPVAVTSIVLGVIVAICLIFGIGTYNSLAKQNQAVEAQWSQVENVMQRRADLVPNLVNAVKGQMGQEQKVFGEIAEARKSYANANTTTGKAKADDQLNKSVGTLINVIKENYPSLQSSNQVNTLMTQLEGSENRISVERKRYIDQVRDYNQSVVTFPKNIFASMMGLGKKDTFKATPSAQTVPSVDFSSNSSSSGK

SEQ ID NO: 8321 - protein, 338 aa, Lactobacillus casei
MAKKVILTGDRPTGRLHIGHYIGSLKNRVELQNSGDYETFVMIADTQALTDNANDPEKIRHSLLEVALDYLAVGIDPEKTTILVQSQIPALFELTAYYLDLVTVNRLERNPTVKVEIKQKAFGDSVPAGFFIYPVSQAADITAFKATTVPVGDDQEPMLEQTREIVRTFNRTYHKEVLVEPEGYFPPKGLGRLPGIDGNAKMSKSLNNGIYLADDVDTVKKKIMSMYTDPNHIHVEDPGKVEGNVVFTYLDIFDPDKAQVAKLKEQYQHGGLGDVKIKRYLIDVMEAVLEPIRTRRAHYAEDMGAVAEMLKQGSAKANVVANQTLQEVRDAIGFNYFK

SEQ ID NO: 8322 - protein, 441 aa, Lactobacillus casei
MAYDYDTIVIGGGPGGLAAAYGLAAQQKVLVIEGDLWGGTCPNYGCDPKKMLYRGVEVKNAALRMNGFGISGTAKIDWPSLMAFKRGYTSGIPAGTLNGLTRTGIKTLYGRAQLLGEHAVKVGSQNVTGEHIVIATGHTPRFPDIPGANLLKTSRDFLDLDELPTSIAFIGAGYVSVELANIAAAGGAEVHIIGHSDRLLRAFPKVATEALKQLLIKSGIHFHPNVELTKISPLGTMTHLHADDFDMNVDMAITAMGRIANVADLGLANAGIKADTRGIPVDDHLRTVVPNIYALGDVNLKPQPKLTPVAGFEGRYVASQILGDQEPIHYPAIPTIVFGPTELAKVGVALEDAEAAPDRYQVIHNDTTQWYTYHRLQDPDAQVWTIVDKTTGKLAGAVVLASLAEDLINTFAAAIDAGKKPAELNQIYAYPSAQSDLQYLF

SEQ ID NO: 8323 - protein, 318 aa, Lactobacillus casei
MALISLENVTKAYDGKPVVDDLSLNVEQGELFVLVGTSGSGKTTTLKMINRLVEPTSGTIKFAGKPLTDYPVRDLRWNLGYVLQQIALFPTMTVAQNIAVIPEMKGWSRQKIRKATDELLTMVDLPPAEYRDRMPSELSGGQQQRIGILRALASRPKVVLMDEPFSALDPISRTQLQDMLLQLHRAMKTTVIFVTHDMAEAMKLGDRIGVMHSGKLLQVDTPEAIATQPANDFVADLFKGAQANQGLQVTLSQLAPFAVAESARHAVGGNLTLAEALPLLDAHETLQVNSDHGTFVVNTHSVVAYLASAFVDQNTETE

SEQ ID NO: 8324 - protein, 510 aa, Lactobacillus casei
MADLWRTVSERHVELLNALGQHIEISLIALVLAVIIAIPLAVWVQTHPKVAAVLLQVTGVLQTIPSLALLGLLIPFVGIGTVPAIIALVVYALLPIFQNTYIGLQDIDPSYEEAADAFGMSRLRKLFKVELPIALPVILSGVRTAMVLIIGTATLAALIGAGGLGTFILLGIDRNDASLTLMGALAAALLAIVFSWLLNLLQKVNWKLSVSVVGIALLGFAGTQVYNWATAPKETITIAGKLGSEPDILISMYKELIQKADPDVKVTLKPNFGQTSFLYNALQTDKINIYPEFSGTVLESLTKPTAAQQKQVAAGKNNYPLAQQLLAKQGLRYLKPMAYNNTYALVVKASFAKRYQLKTISDLAKIAPSIRAGFDLEFIDRQDGYKGIKQKYGLQFKVDSMDPSLRYQALDRGQINLTDGYTTDAQLRQYHLVALKDDKGLFPIYRGAPLMRNSFAKRHPQLVTALNKLANHITEKQMQDMNYAVSVRREKAATVAHRYLVRHGLLKEAR

SEQ ID NO: 8325 - protein, 762 aa, Lactobacillus casei
MENATKAEEQARVTAVIEKLKARLAAIHEQIEAAHRETSRIERAYGENTKVNVTEVDDQMETNAAVQQQKVMVARAVENETILKHEGDRLTLLADNPYFGRIDIDEDGEPDTLYIGTATFIDENGDFLVYDWRAPISSIYYNGTLGDVTYETPAGEQHAVLKNKRQFQIEHGHIKTMFDTNETVGDEILQSVLGDQSDEYMKNIVATIQREQNDIIRDTSSDLLVVQGVAGSGKTSAVLQRVAYLLYHSRSDLDADQMVLFSPNRLFANYISQVLPSLGEKNMRQATLFEFLANRFTGLHVETLFERYEHDAAGLPQAAETIRRFKEAPSYLEAIYDFAKNPDRTPHFIDVEFNGETFFSAPNIAKIYQSQPALMQPVDKFTATKNALIKRLNARIHMEAKQDWAQLQVSDLSQSELETLTADHEFATGEDEQQFVSEAIVSKAFAPIYDALYNDHFYDVFQDYQHFMAQVDAPVSEPVWQTMITAFSDGIESHHLRLEDAAPLLYLRDLSTGSGQNSLIQYVFVDEMQDFSMAQLLYLKHAFPKAKLTLLGDAKQDVFTSNYQPSDFIHEIKDVFAGYKIRLITLNKSYRSTQPITNFAKALLPEHDHIQAFNRAGDKPEVLTVPRADATAALSKLVTRLLTADGTVAILTKDAQTADQLYATLKLDTPVTLLSANDHSLKSGCVILPVYLAKGLEFDAVVGWDVSASTYQNEADRDILYTLCSRALHHLNLVALDAPSPLITALPTDLYRHAGDASEARV

SEQ ID NO: 8326 - protein, 274 aa, Lactobacillus casei
LFNLLRTFMAVYETRSFSLAAEQLFSSQPTVSHHIHQLEHELNVSLFERNKRSATIPTAAADILYEFSSNLLADWDKAKQAMQNTATTASVELNIGISQSVAVVLFPSLARGLKTAFPFLEFNVAVLNSLQVVKQMEARRLDLGFIEQPLTLKGAVRTTLCADQLVVAGWPTGTWLTREEGSGMRYYTTAYLQEAGITPDHLMTVNNNSMLRALVQNKVGQALLSDRIVPQEVPQQTIGAKFRRHFYLLQNPDVHWPHKQAMLDTIQHLANKVD

SEQ ID NO: 8327 - protein, 323 aa, Lactobacillus casei
MTTFLKKVPLPMAGLTLGLASLGNLYKLAGWQLAGDVTGIVALLLFAVILLKLCLTPLHAAKSLQDPIIASVSPTFSMTLMILCTYFTAWGMPIQVATVVWVMAVLIHFGLMAFFLSRHLLTQQKAWHMIYPSWFVTFVGLGVIPVTSAQFVPALGQPLFWIAFVLYAALFPVVVHRVRVVPLPEATQPLLTIMAAPASLCLTGYLASFNQPNFWFALGMLIFAQSLYFGTLFSIRQYTRLSFYPSFAAFTFPLVISATALTRFIGIFAKTGVAHNLLSVVQWSEWLVATLMLVFVTGHYLRFLHLNIRAAWQTQQAPRDTTD

SEQ ID NO: 8328 - protein, 249 aa, Lactobacillus casei
  misc_feature (4)..(4): Xaa can be any naturally occurring amino acid
CAAXAMINTERMINALPRTEASESELFIMMNITYLKIFHSFLQVLGVGIGFILYSFAELALVRGEAAWGAYGAIGAFVISFGVLIGLLMLVYRRWYRQQGPLTVKHPAAVIWQGIGLLFVIQLTNSLLMHLLHTPQAANQSNLLHLVKTYPWGIKLLAVVGGPIVEEYLFRGLLMNSFGSLRQRKWQWVSILVSAFAFGFAHVVGSRIDYNLFIYAALGGVLAWTYLRTRDMRYSIGLHMLNNATILLV

SEQ ID NO: 8329 - protein, 91 aa, Lactobacillus casei
MDAVSYSVFRRNLKHYLQAVNDTSTPLLITSRDNEADTAVLMNKRDFDAMQETMRILSNPELMAKIRRGQAQIAAGKTRQHDLKDVGGGDD

SEQ ID NO: 8330 - protein, 533 aa, Lactobacillus casei
VTFRQYLFRLKWRFGLFILMYGVMIAAMTAVSVFTGNMITALTQFKVNAFVTAAIVMVVATILQLVVQTLVNIYQISLQRRLNNDIRTQITKSIATMPFEQYHSRSDAVYTSWMTNDVNTINTQGLRNVAYLIQASWQVVLSIFVLLTYHASLFITTLVCAVLLITVPMIYRKKLSAAAATWSQENEKLTNRLTDILEGFNTLFMANRRHVMVERVQQASDDAGHAQVGYIQFNMATQFLINLVNLGSQLFLLIQAGLLAYNHIIPVGAVVTIHSVAGTTFSGLTLMSFALTTVKSVAPIFDKFAKSAPAPQEAKTPVTPLTEAIKLQNVTFTYPHKNEPVINDLNLTLQANQKVALVGPSGRGKTTLLRLISDVLADYRGEITWDGHDYRQLDPRSLRDQITYIEQAPYIFNDTLRFNLTLGRQVDDDVLQQAIKGAQLTEFMKHQTQGLDTVLKHNGGDLSGGQKQRIALARGLIRQSRLIISDEGTAALDAKAGLSIEKLLVSLPKTTLIMVTHNLRREIKDQLDRVITV

SEQ ID NO: 8331 - protein, 214 aa, Lactobacillus casei
MIDWQALTAYARSVSTQDHSGHGFDHIERVIAMAKRLAAETPSVDSAVVVAAATMHDTYDDKLVNDVAAARSAARHAMAAAGLTDEQIQAIIAIIDHMSFKANLGKRQPLSLEGQLVQDADRLDAIGAIGIGRAFMYGGTHGGRMYDPELAPRTALTPSNYRTKESTIINHFYEKLLKLKDQLNTPAAKQLAEHRQQVMEDFLTEFKAELGGER

SEQ ID NO: 8332 - protein, 138 aa, Lactobacillus casei
MKKHCLSASQSVNQFHRLFSPVSSSDIPLNQQNLLFWMATELTPKTPTSLAKEMHVTKAAITKASGPLLDRGLLDKQPDPDDYRSFKLVLSEAGQDAVEDLGPEYMGNLERLYNELGEKKYLKLIKLLSQATGVAVEE

SEQ ID NO: 8333 - protein, 842 aa, Lactobacillus casei
MAIPDHISVRGAYVNNLKHLNVDIPLNKLVAITGRSGSGKSSLAMGVLYAEGMRRYMSALSTYTRRRLGQTSPAAADSVKHIPSAIALRQRPVVPGIRSTVGTATEALNVIRLMFSRLGSPVCPNGHRVPPTLDIAKAMDLPNDGESGMGMITCPTCGVHFMAFAAEDFAFNSTGACPTCGGTGQARTLAANRLIPDQTLTIRQGAVASWRLPGRNFMPYVAQAIGIDIDTPFQDLPKDQQEQVWHGQRKKYAINIPSKTGRVFHMDHAQYENAFNAVEDSLATTKNERAIQRLNRFYEFGVCPTCHGSRFAPKLLSQLLVDQNIAQVSDMTLTQLSAFIPKIYQWLPQNMQALAHDIIKELTQLLKPIMDLGLSYLTLSRAAASLSTGELQRIQLSRTLRTETTGVLYVLDEPSIGLHAANVAGLLEVMHGLVDQGNSLVVVDHNTAIINAADQIVEIGPGAGVDGGRILDQGDPATVSRNPHSLIAPFLTGKTQLIVRPQAGAEAVAKAKQLQLTVTDRFNLHNLHVGFPINCFSVVSGFSGAGKSTLIFDALVPALSATKDQPSPTFVRDLKSGGIRHVVAIDATPVGKNVRSTVATYTDILDHLRHLFAALPDAKAKHYTSSHFSYNVKAGACPTCGGTGVINLDIQYLPDMQQTCPTCHGRRYNPEVLKIKWHDRSIADLLDLDVDTALKVFKDEPAIAHTLQTLHDMGLGYLHLGESTPTLSGGEAQRLKLVAHMGRSQKDTLFVFDEPSVGLHPLDVQTLVAVFQRLLKTGATVIAIEHDLDVIANADYVLDLGPKGGAEGGQVMAAGTPQAIASQGHGETAKYLAAHLAAFQVK

SEQ ID NO: 8334 - protein, 334 aa, Lactobacillus casei
MYHAATDRYAKMPVRHAGKTGLMLPAISLGLWQHYGNLDPFDSRRSVILDAFDHGVFHFDVANHYGNGDVDPGYGSSETLLGQILATDLKDYRDELVISTKVGYEIHPGPYGIGTSRKAVIQGLNDSLKRLRLDYVDIYYAHRFDDTVALEETVNALDQTVRDGKALYIGISNYDTEQTKEAIAMFKDLHTPFVLNQFSYNMFNREAETSGLTDALKANGAGLIAYGPLSEGLLSDRYLNGIPDSFQIHRTNKGTFAKGKDAVVKKLNDLNEIAQGRGQTLSQMALAWLLRDPVVTSVIIGTTSVEHLEDNLKATEHLTFTAEEVQQIDDILNA

SEQ ID NO: 8335 - protein, 270 aa, Lactobacillus casei
MAKYLIVSDIDGTLTANHHDVTVNTAQALENAVAAGAAFYVATGRMHALAEVVAKQFQPDASIIASNGAVYDFSGERVHHTLGEEALTAVEEVSADLNLNALYFSDDTVYFTGTLPPAIEAAARKFAPKSVEIKVVGVPSIRELLTHAAVITNGIIFGPNDTKALVAGKTALEARDVLHVSASEHTNLELIPKHVDKANAVRELQEKTGIGPDHTIAFGDGLNDLGMLQAAGVSVAMGNAVPEVKRVARYVTDTNVDDGVAHFLTEFFEK

SEQ ID NO: 8336 - protein, 114 aa, Lactobacillus casei
MAASNTTIDQLNEAAQQTALETFAKFYLNRFFGAGLDVFSQLDKQGDLADINHYLLDNRTLTREELTSGLLTHRSGNLLDLLKQVKVKYNAQGAPETPWQEWYAAQIDKLPQGL

SEQ ID NO: 8337 - protein, 87 aa, Lactobacillus casei
MEKEKLHLGDAVVCQVKEDMEAPFTGKIEKVYENSALLTITDYAEQDRQNASELNFKIVTNFHAMTKNLGGGTVLAFPPESAEDQKK

SEQ ID NO: 8338 - protein, 225 aa, Lactobacillus casei
MQTKDQPIHESLLIGTLLTGAAGSFDAFTYLLHGEVFAGLQTGNVILLGVHLSQAQWYTAIRYIVPILAFMFGTMAARAIQLQADKRQHPLSEQRWIIRYEIGLILLVSLLGRWLPDLVASAMVSLIAAAQLQEFRRLRGGPFTSLMMTGNLRTAAQNLYDGFIRGQQKSRESAAVIGTIILSFAAGAGITSILTHYIGTYALAGAALCLIAIDGIFWQDQIKLH

SEQ ID NO: 8339 - protein, 233 aa, Lactobacillus casei
MTTLYLVRHGQTEFNVQKRVQGMADSALTAKGIADAKALGLGFKTAGIRFNAAFASDLTRAIDTAHFILSGLDEPLPVTTLMGLREENYGKFEGQLANDFSLATMGVANFHKALANREITLAQTADAAFAANMDQHPNTAETNRMVQERLNRTLRAIAVEAETKDWQRVLVVTHGTAALMWLNYIHYNIDGREMLDNASVTKLSWTNERFRVTDFNDLGFLHQGQKVAGEASA

SEQ ID NO: 8340 - protein, 63 aa, Lactobacillus casei
MKITRSLAQEPAYKDLGRNGQKPTITPKATYTPAPERAGSRSQKLGDYYHDNALSCPSRANRI

SEQ ID NO: 8341 - protein, 270 aa, Lactobacillus casei
MNRYLIALDLDGTTLNADGQLSAGTIAVLQAAQAAGHLVVIATGRPDAISEQFYDALKLQGPMINFNGALIHMPHRHWQYEKEVTIPIPVALSLRQLKQEFAFKVMVAEGKRLLVADRPYANIPFLPDRLHPDALLDEQGLRQAPISVTMFMEAKIFKPVAAQVAALYPHLAAKTWGAWSGEYTALEVTSRNTSKSRALAYVAGCYGIDQSHIIAFGDDMNDLDMLQFAGHGVAMKNARPAILAAADAHTPSDNEHDGVADYLADYLKLA

SEQ ID NO: 8342 - protein, 160 aa, Lactobacillus casei
MAESIVLYTDGGNRNTGNHAGGSVRPTDKSAWAALLIYGEHEKMLSEGDYGRTNNYMEIMAVIQGLKAIKRTDIPVDVYSDSAYVINTMQQRWWVKWQQNGWRNHGKPVKNAELWQALLHQVNRFDHVTFHKVKGHATNHNNNRVDEALNQTMDRLDDRS

SEQ ID NO: 8343 - protein, 300 aa, Lactobacillus casei
MGNFSYEVFSKVVERGTLAQAAAELNVTPSAVSHSISQLESELGFPLLIRNRTGVTLTEDGAQVLPIIQSIQNLEEQLSQVADNINGVNTGRIRIGAFSSVSTNWLPTIIQRFKKRYPHIEISVVQGTFNRIVDAVRLGTADLGFSSLPVGPGVVVEPLLKDPIYCITPKSFKPKNGKTVTQADVEKRNFILQQIDYDRDTKRALDRYHVSTNTINYSIDDQSILSMVESGLGLGILPKLALQKLVGDVNVYPFSEPFSRTLCLVINPTIKKSPSVQKMQQVINGFLAETYGEAFLGHQG

SEQ ID NO: 8344 - protein, 401 aa, Lactobacillus casei
MKFAKRTQKTGKSGLEDLFAASGPNVISFAGGYPDRSLFPTQQLNRAFKHSFTSGDTELLQYASTQGYLPLREKIAARLRATGMPTRAADIMMTQGAQQGIDLVARLMLDPGDGLVVEAPTYLGALAAFNAYQPTYYEVPMQDDGIDINALQRVLMSRSVKFIYTVPDFQNPTGIVMSLAKRKAMIRLANQYDVMILEDNPYRDLRYDGKPLPTIKSMDTEGRVIYLGSFSKILSPSLRMGWLVAAPELLKELIALKGGSDLESSNLTMHGINDYMEENDLDAHIKQIQDRYREKKDAMVDAMTRYMPAEAHFNNPDGGFFLWLTMPAGFDMGAFMKQHLLPENNISYVPSANLYATSAQVNGARLNFTGPTLDQIDTGIKALGDALKMALHQPTLVAEQA

SEQ ID NO: 8345 - protein, 40 aa, Lactobacillus casei
MVPILLAKYDENVMVTLSFCKVYRLSNTIRQVTKPVRQPE

SEQ ID NO: 8346 - protein, 397 aa, Lactobacillus casei
MAKKTTTKNANTKSDTTDRETELEKALQKIKKAFGEGAVMKMGDRPELKVDVVSTGILSLDLALGVGGLPRGRIVEIYGPESTGKTTIALQTIAELQKSGGKAAYIDAENAMDPKYAAELGVNIDDLLLSQPNSGEQGLEIAEMLIESAAVDIVVIDSVAALVPKAEIEGAIGDSHVGLQARLMSQALRKMAGSINNTNTLVIFINQLREKVGVMFGNPEVTPGGRALKFYASVRIEVKKGQQVKDGKDVIGFASKLKVTKNKVAPPFKTVETTMSFGHGIEHNTDMINLVTEKDSKFDVITKSGSWYNYGKERLGQGLVNASHYLDEHPEISKEIEAKIREQAAPKKPEETDDDKKDAKKDVKSTDEDKTEKPAETDEKQDDKKDDPSSFGVDRLV

SEQ ID NO: 8347 - protein, 70 aa, Lactobacillus casei
MAKAQPFRFGATYAPVSNRACSRSVETRSLGQKPACKDLGRNGQSPAITPEAAYTPVSKRPSSRSAENML

SEQ ID NO: 8348 - protein, 232 aa, Lactobacillus casei
MMFMGSIVNGLTIIGGGLLGLVLHNISDNAKDTITKSLGLGTFALGIQMALQTKSFIVIIISLCLGGLLGEWLHIEDGMNHLGLKLQERFAKGNSHFAEGFVTATLIAVIGAMSILGAIQAGVSGDNATLYTKAVMDGFMAIMMTASLGVGVMFSAIPVVLYQGTITLLASFLVQFIPKTLLATSLREIGAIGGLMILGIGLNLMDITKIRISNLLPGLLVLLAILTGQYFL

SEQ ID NO: 8349 - protein, 184 aa, Lactobacillus casei
MQIRTFRVKLFPAGQVAFRGQGKWGGNMKKQHIVVRVRRPDGLVLDFRLPKDVTHAIKVSPQTDWFERLRGGLIVAPMAPYVGKGHTAFFIGRIERVYYSGRQLKRFTRSQFLLPDVWREQDLLESFTFLRHDHAWLNRLYIKDDLRYWYHDANSRVLAKIRDWHCKVVYRRFQSGRQGLIPNF

SEQ ID NO: 8350 - protein, 69 aa, Lactobacillus casei
MLRFLTGLAHAHTKKADRWVGGLLGVSDRLGDDRRFLLWRSKNEKVGLGFVGMSGWLISMFLILPTVCE

SEQ ID NO: 8351 - protein, 674 aa, Lactobacillus casei
EIIABCCMPNENTMAKYDLIAATGCATGIAHTYMAQEALEQAAKKMGLTIKVETHGQTGVDDPLTQDEISGAKGVVIASDIDVDADRFAGKPLVNVPVAAGIREPDKLIKEALSDSTPVYMPKGGTAKAGTNENVETSTAGIGNKIYTSLMNGVSHMLPLVVAGGVLIAVSFFWGIYSADPKNAEYNQFAAMLNAVGSAAMGLMVPVLAAYIGEAVAKRSGLIVGMAVGMIAYNGGNGSGFLGAIVGGYMAGLVILMLQKVFAFMPDKEFRGLKAIFLYPVLGVFIAGSIMYLINTPMKAMNLGLMAWLKGLESSSPIILGVVVGVMCAADFGGPINKAAYLTGTALLAQGNYFFMAGVSAACIAPPLATTISVLLNPKAYNRDERSAGYVNALLGSTHITEGAIPFAAKNPLMNIPAFMVGSAIAAVLTYMSRIQVPAPHGGFIVLPLVNKPFLWVAWILVGAAASGVLLAMIAGRSARKRGVKTGVVEAALAAEGTADDATAAPVKVDPARNQPAPVDDQADQTFDPSDILSKENIEVDVPAKTRDDVLHYLADMAVKNGLATDADAIFKKYVAREEEGSTGMEKGIAIPHAQDATIKQSAMLVLHLAQPVDWKTFDGKPVTAVISFLIPEHDSGSHLKYLSNTAKLLTHEDFVKAFQAARTPDALYALFKR

SEQ ID NO: 8352 - protein, 104 aa, Lactobacillus casei
MRMNKRLAKNLHRSLFGKFKVIMQYKAGWYGNTLVLADRFYPSTQRCSRCGYVKTADERVTLSGNLKHRTGHDDYHCYQCGVRLRRDENAVENLIAYAKSKVTG

SEQ ID NO: 8353 - protein, 315 aa, Lactobacillus casei
LIYTLTLNPAIDLFIKTQTMAPNTVNRTDSYDIQANGKGVNVSCILKRRGVDNVALGVGGGFTLDYIADFLTQQGIRNHFYRDAGFTRINVFTRVVSDNTEYKLVNPGPEISSATLKQLYQQLTTLGAEDWLCVSGSFARGIEPSFLLKLGALSQKRGFQLIIDSAYPEAVKALAYRPLLVKPNDAELMSWFDQSGAADLSTMVALGHRALDAGAQNILVSLGAEGALFMNHEVTLVGNAPKIDVLNTAGAGDTMLGTFLAGLYQKQDLAATLKLAIAAGSDTARRAWITDFTQTDELLTQIEIKQLEDVNNTQI

SEQ ID NO: 8354 - protein, 250 aa, Lactobacillus casei
MATLSPTEAYLWDYIENHQQTVVNASITQLSAAANVSPATIVRTMKKKGFNGYTEFRHDLLKRIGDAEPFGILDQVDDQIKKVIMQNQIEVHNTLDNLKVSVIEDSVQLLAKAEIVLVLARGLSESIASEITLKLQLLGKYAEFFSDPNIIQTIAGQISPKAVALTITLNGETPELVAAAKTLAARDIPQIILTTNAEAPIVQYADELFVGYKSKAAYFDKYEVASRLPLQVMSRILLDSYVVRKRKQAR

SEQ ID NO: 8355 - protein, 869 aa, Lactobacillus casei
LDSKVHYKRYKSGKFWITALISVSFGIIGSLAVPQLCEAVPVYATSITDVSIKVGPNEFSQYFKLSGSASFYPKDSKTQVQLTPNLPDRTGSVALNTKIDMSQSFTLKGRLYLGDDPDGADGVAFGFADTKPGVLGDAGNAFGLGGLKNAFGVKFDVYYNGVRTEGALPDVYRANQMNVIYTDDAKGNIVAGVDGGEGVSHAKIQGANGQYSELIVNYDGDNRIMTVTGSGATIKFNAAPYIKNDQLSMFISGSTGGKMNQHVFDFESFSFTPGLDTVKENLKNNLPPTITAPKNAINQDPTLTNAQRQQLCDAIDQALQNGKSAIDQATKTGDAIAAFDTAKAKIDDIHKSGPPLADQKATQKQALKAKRDQIADVSYKDYALTMAETKQQTLAADQALADATAAVDAASDANGISQAAENGLKKIAAAYQPGVPLADQKAAQKNALANAATSAKQTIQKDPTLTTAQRKKQFGLVDNAVTDGETAIDAANTADKINKALAAGKISVNQVHQSGVPLADQKAAKKQALKTKRDEIADTSTKDLTLTMQETNDQIAQADKALSAANAAIDAAAEAGVVNQAATDGLQKITDAYQPGASLADQKATQKKALKAERDRIADVSYKDYSLTLAETKQQTSVADQALADASAAVDAAASADAINKATASGLKQIAAAYQPGVPLADQKAAKKQALANTADKAKQFIQSDRTLTTAEKKTQLASVDTVLKDGEAAIDAAITADKINKAEATSASAILNVHQRGTDLADQKTAQKQALKTERDKIADISFKDLTLTMAETTRQTDTADQALAAAETAIDAANDADGIVQAADDGIQKITAAYQPGIPLADQRAAQKKCWQPKPPTLSKRFKPIRL

SEQ ID NO: 8356 - protein, 1873 aa, Lactobacillus casei
MLATEAANAKQTIQADPTLTTAEKQTQLASVDTALTDGEASIDAVGNADKINKAAAAAKDKINKIPQSGVAVADQKAAQKKALQAKHDKITDVINQDLTLTSEAQKHQISQADKAFSDATAAIDTAADADTINQAAEDGLKAIAATYHPGTPLADQKVAQKQALKAERDRIAEVSNKDLALTMTETNHQISIADQALTDASAIVDAAASADAINQATADGLKKIAAAYQPGVPLTDQKAAQKKALANDAANIKQAIQGDPTLTTTQKAQQVANVDTALADSETAVDTAKTADAINKAVAAGKTSISNAHQLGIAIADQKAAQKQALTSKHAEITDVINKDLTLTNKEMKRQISQADQMLTEAKAAIDAAADADAINQAADNGLKKITSTHQSGTPLADQKVAQKKVLADAADKTKQSLQGDPTLTTAQKQQQLTSLDAALATGEANIDAATSADAINTAAAAGQANITNAHQSGAAIAAQQARQKQALQAKQAAVIDRIIHDPTLPATEKKTQTALVDQALLTGKQAIDAAVTADAIQQAATVSQDNIDKAHQSGVAIDDQKAAQKAQLTAHAKQVEQAIKDTPTLTTAEKSTQLDAVAKALTTGLNNIDAATTADQINAASVTGKTNIAAAYQVGLPLNTQKDNKKKQLKNAVTQAKQTIQGDVTLTSAEKQHQLDKVARTSKTVSDAIDNAKTADAINAAFDAGKVDIEKVHQLGTPLTAQKDAQKQALANELAKVKQAIQADSTLTTAEKQQQVNHAKEAKKAAATAINNAKSADAINAAFDAGKANLATTHHPGAAIAVQQAAKKQALNQELAKIKQAIQHDATLTTAEKQQQADATDNAGQTAATTLDAAKTADAISAAFNAGQAAIKKTYHPGKAMADQKTAQKQALDNVTAKIIQAIQGDATLTTSQKQQQADAAAKAAQATATVIDAAKSADDIKAALVAGQVTVAKVHQPGSPIAAQQATQKQTLDQEASTTHQAIQHDATLTATEKNRQFAAVTTANKTAQVAIDAAKTADDINAAFTTGKTAIHQAHQAGKPIADQKTTRKHSLASEVLKVTQTIQSDPTLTATEKSQQANAAAKAGETAKTTVEAAKTADDINTAFAAGKMAIAKTHQPGTAIADQQAAQIQALAQAAAKTAQAIQADPTLTTAEKQQQATAVTNAQKTAQTAILAAKTADAINAATVAGRIAINNTHQAGTAIDQQQITQIQAIADKATTVKQAIQVDATLTAAEKRQQITAVNQIEKTTQAAIKAAATADAINTAATTGTTAAANAHQNGPSLADQKAAQKKAISSVSAKVKKTIQADPTLTTPEKQQQLTAIVKAEATALANIDMATSADTINAAFDAGKVLITNSYQTGTPLADQKTAMKRLLVSKVDRTKRSIKNDPTLTIVDKRQQTAAVDNIDHTIQAILTTAATADAVHTATTAGMTNCTNAYQAGLSITDQKVQRKRELDDVTAKAVQTIQTDVTLTAKEKKAQADDVHKVNQTAVAAINAAKKADALNAAFAIGKIGINSVHRVGQSLEIQKTHQKQAVATAANNAEQTIQSDPTLTAADKTQQITAVGETAKLAANAIDKATSADTIKIAATNGIIAINNVHQAGTPIADQKAQQPTPDVATIATDNQAIADNTAQMVTEKSEQSSTVDQTVQQAEAALDATPTADAINKALAVSEATPDQPHQPNASSTLEKADEEKVTQSEHDQVTERITGSKVLDREPQASAKITLTNQQSSDKVLADKQREVIEITDIETEDEQEQLEYDPLLAVVQKDTEESQTIREQPDQEKDITKSPVHHETKIDTGNTPNIPKPEQLPVQETPEVVNLAKPANQAASLPQTGDNKSHGLAVLGTLILGIAGLTTSGKKRKRT

SEQ ID NO: 8357 - protein, 100 aa, Lactobacillus casei
LFAIFLLFIAAAVILLGVTVVGALIPTVVSANVPLVFKTGKVVLKAQTVLNQIMPSLVPVALVALSYWLLGKKKMNSTRLIVLVLILGIVLGAFGIIGKS

SEQ ID NO: 8358 - protein, 2377 aa, Lactobacillus casei
MERKVHYKSYKSGKFWVAALISVSLGTVGVITIPQIFEAVPVYADASPTDVTATVDPNDFLNYFKLGGSTGAGKQPAIPYPAGQQGYQVQLTADAQGQAGNVALKTKIDMTQSFTLTGRLYLGKNASGGDGVAFGFADANPGDIGQPGNAFGIGGLPRAFGVKFDEYYNGGGDKYAAADLDPGDYPQMRVVHTGPGDNPTQVVGVKGAKGVFYNNIPAPNGQHVDLVITYDGQTKQMTVKYGTVGITFDAGPYIKNEQLAMFLTGSTGGVTNQHLFDFLKFTYTPGLKAVQADLKNRLLTEANTQKAAVNADPTLTTDDRKSQTDKIDVALKTGQDAIDAAATTPDAINAFDTNKPKIIAVHTPGQPLADRKADRKAKLQAEHDKIVKDINSDPTLTAAEKTQQITNADTALSNANTKVDAATDADNVDLAFSNGKAAIDAAHKPGATLDAQRTAKKAALDTEAATIKQAIQDDATLTSAEKKTQSDAVDKALTDAKSAIDNATTADTINAAADTGLANIRNAHQSGPSLADQRTIQKQALKAKHDQVVNDITLDPTLTAAEKKTQITNADQALTDGNAAIDTAATADAINQAATVSQANIDNAHKVGKPLEDQKNAQRQRLNNEATAVKKKIQDDVTLTTAEKTQQTANVDKALTDGLNAVNNATTADGIIAAGDDGIAAIDKVYQTGTPLDDQKTAKKTAIDNAAAIAKKAIQDDPTLTTAEKKLQTDAVDKAVTDGKKAIDAATNADDVNKAANTAIATINQAHQPGKSIDDQKDAKKKAIDKAATDTKKAIQDDPTLTTAEKQQQSDAVDKAADAGKKAVDAATNADDINTAGDTAITDIGKIHQPGKSINEQKDAKKTELDNEAAKIKTAIQGDPTLTTDEKNKQLDAVDKALEAGKKAIDAATNADDINTAADTAKTNIDNAHQPGTSIDDQKKAQKEALAKEATTVKEAIQNDPTLTTAEKQQQTDNVDKALKDAEAAIDNATTADEINTATATGKTNIDNAHKPGTSLDDQKVDQKKKLEDEAAAVKKAIQDDPTLTTAEKQQQTANVDKALKDAEDAIDAATNADGVNQAFSDGKAKIDAAHQPGQTLDDQKATQKKALEDEAATVKKAIQDDPTLTTAEKQQQTDNVDKALKDAKDAIDAAKDADSINQAFSDGKQTIDAAHQPGKTLDDQKAAQKKALEDEAAAVKKAIQDDPTLTTTEKQQQTADVDQALKDGTAAITNATNADEVNQAFNTGKTNIDNAHQPSTSVDDQKANQKKALDDIAATVKKAIQDDPTLTTAEKQQQTTNVDKALKDAKDAIDAAKDADSINQAFSDGKTNIENAHQPGQTLDDQKNNQKKALDDEATKIKQAIQDDPTLTTAEKNQQIAEVDKAVKEGKAAIDAGTNADEINKAFTDAKNNVDQAHKPGKAVDDQKDAQKKLLDDEATKVKQAIQDDPTLTTAEKQQQTDNVDKALKDGKAAIDAAKNADEINQAFDTGKTNIDNAHQPGASIDDQKAAQKKSLADEAAKVKKEIQDDPTLTTAEKQQQSENVDKALKDGEAAIDAAKNADEINQAFDTGKVNIDNAHQPGTNLDDQKAAQKKSLADEAAKVKQEIQDDPTLTTAEKNQQTANVDQALKDGEAAIDAAKNADEVNDAFNTGKINIDNAHQPGKTIDEQQTLQKKSLNDEAAKVTQEIQNDPTLTTAEKQKQIQDVADALKAGEAAIDAATTADEVNQAFDTGKINIDNAHKPGTAVNDQKEAQKKSLAEEAAKVKQEIQDDPTLTTAEKNQQTANVDQAFKNGEAAIDAATNADDINKAFDIGKINIDNAHQPGKSIDDQKNAQKKLLDEEAAKVKQDIQNDPTLTAVEKQQQRENVDKALKDGNAAIDAATNADDINEAFDTGKTNIDNAHQPGTSLDGQKEAQKKSLADEAAKVKQDIQNDPTLTTAEKQHQSENVDKAFKDGEAAIDAATNADDINKAFDTGKINIDSAHQPGTAINDQQAARKKALDEEAAKVKQAILDDPTLTTAEKQQQTADVDQALKDGKAAIDAATNADDINKAFDTGKINIDNAHQPGKTIDEQKAAQKQSLNEEAAKVKQDIQNDPTLTAAEKKQQTENVDKALKDGTAAIDAATNADEANQAFATGKINIDKAHQPGKTLDDQKAAQKQSLADEAAKVKKQIQADPTLTTAEKQQQSENVDKALVDGQKAIDQAQDADSVNTAFATGKVNIDAQHQPGKSLADQRLAAAAEIDKEVAKVKQQIDNDPLLTDTQKDEQKANVDREAALAKEALAQAIDADALNAALAEGIKKIDAQYVPGTAPAPDPTPGPITVDPRPTPTQPLSTMQAPTSPLPRTGDKPATGLAALGAFILSMFGFALTGKKRKRF

SEQ ID NO: 8359 - protein, 1892 aa, Lactobacillus casei
MESKVHYKRYKSGKFWVTALISISLGTFGVITIPQIFEAVPVYADTTPTDITATVKPDEFLNFFQLGGGTDPSQGSAVHYPSGELGFQVQLTPDVPGQIGTAALKTKIDMNKSFKFQGRLFLGTKANAADGVAFGFADEDPGKTGKAGNTFGIGTLKNAFGVKFDEYYNGQEDPGSYFKDPGVETDYPQMRVIQTVGPLGKVKSIEGAEGEFYQKLEDPKGQYLPLLVDYNGDSKRLTVAYGNKSISFDAKPYIQNDQLSMFIIGSTGDQSNQHLFDFESFTYTPGLDAVKADLKNRLATEADTQKAAVNSDPTLTTPERQKQVTDINTALKTGQDAIDAATTTPDAVHAFDTNKPLIIAIHQSGLPLDQRKANKKAELKTEHDNIITAINNDPTLTSDQKNQQRGNADTALTNGNTAIDGATDADKVDQAFLNGKKAIDDAHQPGATLDEQKTAKKQALEDAATKVKQDIQNDTTLTTDEKKAQTDNVDTALTAGRDAINKADTADAINTAAETGLANIQKAHQPGLSLDEQKKAQKKALKDKYDQVVNDINNDPTLTTAQKKPQIKNATDAFNQGNQDIDNAATADAISQASTTSQANIDNAHQAGKPLEDQKNAQRKRLTDEATAVKKKIQDDVTLTKAQKATQTTAVDQALTDGLKNINDAKTADDINTAADAGITDIDKAYQTGTPLDAQKAAMKTAIDNAATKAKKDIQDDPTLTNAEKQQQIDAVDKAATVGKDAIDAATSADDIKTATDDAITNINKAHQPGKSLDDQKENKKAAIDNAATDAKKAIQDDPTLTTAEKQQQSDAVDKAAENGKTAIDGATNADAINTAADTAITAIGKIHQPGKLLDEQKDAKKTELDNEATKVKKDIQGDPTLTTAEKKQQTDDVDKALKDGKAAIDAAKDADSINQAFSDGKTNIDNAYQPGRTLDEQKKDQKKALEEEGEKVKQAIKDDPTLTTAEKNQQIAEVDKAVKDGGAAIDAGTNTDEVNKAFTDAKQNVDQAHKSGTDINDQKDAKKKLLDEEAVKVKQAIQDDPTLTTAEKKQQTENADKALKDGKAAIDAAKNADEINQAFDTGKANIDNAHQPGASIDDQKAAQKKSLIDEATKVKQEIQDDPTLTTAEKQQQSENVDQALKDGEAAIDAATNPDDINQAFDTGKVNIDNAHKPGTSLDDQKAAQKKSLVDEAAKVKKDIQDDPTLTTAEKDQQAANVDQALKDGEAAIDAATNADDINKAFETGKVNIDNAHQPGKSIDDQKNAQKKLLDEEAAKVNQDIQNDSTLTAEEKKQQTENVDKALKDGNAAIDAATNADDINKAFVTGKTNIDNAHQPGTSLDDQKAAQKKSLADEAAKVKQDIQDDPTLMTAEKQQQSENVDKAFKDGEAAIDAAKNTDEINQAFDTGKANIDKAHQPGTAIDDQQTARKKALDEEAAKVKKDIQDDPTLTTAEKTQQSADVDKALTDGKAAIDAAKTADDINKAFDTGKTNIDNAHQPGKLIDDQKTAQKKSLDEEAAKVKQDIQNDPTLTTTEKQQQADNVDKARQDGQAAIDAATNVDDINQAFETGKINIDNAHQPGKSLDDQKAAQKKSLDEEAAKVKKDIQGDPTLTTAEKQQQSENVDKARKDGQAAIDAATNADDINHAFETGKVNIDNAHQPGKTLDEQKTVQKKSLDEEAAKVKQDIQNDPTLTTTEKQQAENVDKAHKDGQAAIDAATTPDEVNQAFATGKANIDAQHQPGKSLADQRSTATTKIDKEAAKVKQQIDNDPLLTDTEKANQKAKADHEATLAKEALAKAIDADALNAALADGIKKIDAQYVPGTAKTPTPDPATKPLTVDPRSTTTRPLSTTLTPTSSLPRTGDKPATGLAALGAFILSMFGFALTGKKRKRS

SEQ ID NO: 8360 - protein, 105 aa, Lactobacillus casei
MARTKKMLLVVGALIVISVVALLSIHNEWTDRINPFISEETSFAKVPLKTQTYQDVKIYSKTGQKLSYTLKHVKGYDATQQYAAIQHKGQYVKHLSYVSKAPFVE

SEQ ID NO: 8361 - protein, 147 aa, Lactobacillus casei
MTDSIGILLKKLNNDLQRYADREAKQMGLTQVQMSIIDFLARNGSHRSLYQTDVEREFNIQKSSATALLQLMERKALIVRTPSKEDARYKAIQLTPKAEHDAAHIRAYFEQNDAFLRDALGENADVVMTALEQLQQVMAGKLAQVDG

SEQ ID NO: 8362 - protein, 464 aa, Lactobacillus casei
MTRKVSAKLYLSILATGLMAFCGVLIETAMNVTFPTLMKQFQVNTGTIQWLTTGYLLVVSIIVPISGFLKRRFTTKQLFLTATAFFILGLAICSVANDFALLLIGRLIQGCGTGIALPLMFNIILEQAPLDKIGFLMGIGTLVTAIAPALGPTYGGVLVDLNWHLIFIFLLVVMVIALFLGLFSITQVTKPVHVHLDFIAWLLIAIFFAGAILGLNRIENAPGQAAIYGVVAILGLIGYTLRSLHVKEPLINLRLLTNASFDWHVITFLIIQIVNVGFAFVLPNYLQLVNHTSSLIAGLLLLPGAALGALMAPMSGKLYDNLGPAKPIFIGLALQLVGILLLLVTALTATPVMLMLGYAAVMLGTGFAMGNIMTSGQAQLTKAETTDGNAIFNTLQQFAAALGTACVSLIVALAQVPKTTAHTTAVGALHAFWFLLILAIIGDLAIAIGLKTRHAQTQAASHDA

SEQ ID NO: 8363 - protein, 486 aa, Lactobacillus casei
MTDKLTTGEGQAWADNNHSLTAGERGPVLLQDYQLLEKLAHFNRERIPERVVHAKGAGAKGVFKLTHDMKAYTKADLFNGVGKETPVLLRFSQVAGESGYPDTIRDVRGFALKFYTQAGNYDIVGNNTPVFFVNDPLKFPDFIHSQKRDPRTHRRDNNMQWDFWAHSPESTHQVTYLMGDRGNPASYRTMNGYGSHTFKWVNAQGEAYWVKYHFISQQGVQNMTDEVAAKIAGTDTDYLQNDLFSAIETGNFPKWTVYVQILPYQEGLDYKYDIFDVTKVVSHHDYPLIEVGEFTLNENPENYFTDVEEAAFSPANFVPGIEASPDKLLQGRLFGYKDAERYRLGANYEQLPVNRPLNPVHNYARDGFMAAKQDRSVNYEPNSHGGPEEDHSARIHQDAVNGKIGNYKPYDEDNFSAAGRLYRVMSEDERTRLVTTIVNNLKQVTSQEVRVLAAHNFYQADPEYGSRIAEQLGLSLEDVKAGKAEA

SEQ ID NO: 8364 - protein, 251 aa, Lactobacillus casei
VFKNERLNRIMTILEHKKVVSTTDLEKTLFVSNSTLRRDLMTLERLDKVHRSFGYVELVKADNLELPYLFRGQERAPEKHRIAATASVFLGDNQAIFIDSSSTASFLAPFLAKLNHVIVITNGLRIAVELDGLPSIKTFVTGGRLRNGAGSIIGDDAIGFLNNFRANLFFMSCVGLTNDGVFMSSQEQSSVKRAMMQHAEKTILLCDHSKYNVKSYYRLCHEDELEAVVSDARPDQPLATSLEKAGVEVLV

SEQ ID NO: 8365 - protein, 266 aa, Lactobacillus casei
MEMMFQAERDDLAHTVRVMFDRKDTNVAGGNMSVKVFDEQEHPYILMTPTFMSETYYSELHPAQILVIDAETGQKIDGVGDVTREVNMHEKAYNAHPGIRCVYHSHAEESMFWATAGLDMPNVTEATRELGRIRVLPFAPATSMELANTVYTALKEIGDKAMENVFLLDSHGILITSTDLHIAARIMETLEWNARIAYQQAIFIKLGLLDDYHSCGQNYQKPYKEVPPIAVPGIPIKAKQVPLPKNPQRPASEMQPGEVTPASTVK

SEQ ID NO: 8366 - protein, 145 aa, Lactobacillus casei
MLKHIPKQLSPALVEALMEMGHGDEILLADANYPARTNNARVIRADGLTIPTLLQGILTLMPLDPYADYQAVVQAVVPGDKNVPEGEPLIWHDYRAELAKAFPDFHLKSLERFDFYDHSKQCFAIVQTGEQALYGNLILKKGVIS

SEQ ID NO: 8367 - protein, 447 aa, Lactobacillus casei
MGTTSKQPVTKPATKPIVYLFAILGGFAGLLYGYDSGAISLALPSITTAFGLNSAEKGLVVSFLLFGALPSIVVFTAMEKKIERRNVLVLGGIIFIAGSIFSALSTDTLMLMIARFVLGVAAGIANMYGLIYLSELAPAHIRGLMSSLYQLSVNVGILAAYAVGAYNLPTDSWRWTLGLGAVPAAVFAIGMMLSPQSPRWLIRDQKVDKARKVLKRVRATDDEVESEIQDIQDSLKSQEAGMRELFGAFRPAMLLLFTLTFFQVFTGINAAVYYAPEIFHNLGMANASIIADFAVGSALVISTLMSLPFIDRLGRKKLLEISLAGQVPPAIVLCLWSNDATIAIIAIFVYVFAFGFGLGPVFWSYVPEILPLKARALGMGVITFTQYLFNGLLSLVFPMMLEALGINVFYIFAALSVLAVVYIHRNVLETKGRTLEDIEHYWETKHA

SEQ ID NO: 8368 - protein, 509 aa, Lactobacillus casei
MAITNLIAVDLGASSGRLISGQFDGDQIHLKEQFRFSNQPVAVNGHLYWDYLKIFQEIKYGLAIARRDLGRIDGMSIDTWGVDYGILSQRGELLFAPHSYRDSRTEAVKKAFYQRMSPCKLFLETGNQAAMINTNVQLFADVTRYPFLLTEGADVLMMPNLIGYFFTGVKQTDFTIASTSGLLDVANRDWDEAVLHKLGIPRNWFGQLVTGGAVLGPLHPEIQAELQLNDDMQVINGVGHDTAAAVLALPLTSEDWQQTAFISCGTWSIIGRKTAKPIVSLAAADAGLTNEGCFDGSNRLLQNVTGLWIVQELQREWSYQGEMVDFGKMTAEAQAAESLHSYIDPNHPLFTGPSRMEEKIEAFLHQTGQPLPQSRGQLVRTVLESLAMTYRQTIFNLEQAAEMPLTKIHMFGGGIQNQLLVQLTADLTQMPVSAGPIEASVTGNIVSQLLVLKKLAPEDVAATMKRSYTVSTIQPQAVPDLDAHFKTFQQIVERGKAVAAELSPKMEAK

SEQ ID NO: 8369 - protein, 595 aa, Lactobacillus casei
MTNMTFPKIGIRPTIDGRRRGIRESLEDQTMKMAHSVADLLAATLKYPDGSPVQTVISDTTIGGVKEAAMSKEKFDRAGVCGTITVTPCWCYGSETMDMSPDLPHAIWGFNGTERPGAVYLAAVLAAHAQKGIPAFGIYGHDVQDADDTSIPDDVKTKLIRFAKGALATGIMRNKSYLSIGSVAMGIAGSTVDPDFFQEYLGMRNEYVDMTEIVRRWDEGIYDKEEFEKALAWAEKNTPIGPDLYNEDDPNKFTDEQKHEQLVACVKMTMIARDLMDGNKKLADMGFKEEAEGHNAIAAGFQGQRQWTDHFPNGDYMEAFMNSQYDWNGIHQPHVFATENDSLNATSMLFNYLLTNTPQIFADVRTYWSPEAVERVTGTKLEGLAKNGFLHLSNSGAQTLDATGQETIDGQPAIKPFYDLSEEEAQANLDHTRWIPANIGYFRGGGFSSNYVTRGGEKGMPVTMARLNLVKGVGPELQVAEGYAVDLPENVFDIINKRTDPGWPSTFFVPILTGHGAFKSVYDVMDNWGANHGAISYGHIGADLITLASILRIPVNMHNVPEADIFRPRAWSSLGTENLEAADFNACKNFGPLYK

SEQ ID NO: 8370 - protein, 233 aa, Lactobacillus casei
  misc_feature (4)..(4): Xaa can be any naturally occurring amino acid
CAAXAMINTERMINALPRTEASESELFIMMNITYLFFVLIMSYEKSAVTLIALTVTWVLANAAIIYIAYRFVYRYTEKPIIQKANLSDLLYVFGGYATILISNGILTFLNHVIYNRVQSPNNLAIEKSLLNHHQLMVAVLIIHLVVVTPIVEELIYRGMAFNLFFNSNQVWLKILLSAVLFSSAHQSNTIFSFLLYAFIGIILGFVYWKSGKLQNSIALHALTNLVAVLATLV

SEQ ID NO: 8371 - protein, 321 aa, Lactobacillus casei
  misc_feature (4)..(4): Xaa can be any naturally occurring amino acid
CAAXAMINTERMINALPRTEASESELFIMMNITYMKKEPLASQVFVVLVIAFGWSFLAQIVPTLMVMFGMDNDALLGNPWYQVLFLYTEAIGISGMYLYYHKDNALIPLRSARPLKSYLLGWLLGLLFFSAIWGVITGLGGYRLHFVFSNNSIVLVLLFLFGYGVQSMFEELLCRGYVMGYFLKEKRPLLAVVINSAFFAFLHIANPHFDWHAATGLFLFGVLMSELRLLSHNIWLSGAVHAAWNFAEGTIFGTVVSGLPNVGLIIKSDNTTTAQMLTGGLFGIERSSVSIIAHLVAVIILAFVILQRKGRERPDQASASD

SEQ ID NO: 8372 - protein, 288 aa, Lactobacillus casei
VTDTFANFGLLLAAMRKRRQLRMADIADSTSLSTISRFERGSQTISIKLASDLFRRVHASLPETAELVDGSTEIPEMWQTLAEAALTEDTRELDKTIDAFEGKPDTINAMIVTVLKTYRSIFKHEKLDRGHAIAPVIHYLLGNGRWFLLEFQLFAASIYLANPEDSRHCLIRAIHEIEHAHAHIFLEPFTSGLFYAAVAAIEKHDVPTANVLLGNLRGLVATADTIFLKYRIRMIEAALRCSLRNEPHEYQHIVEMLTFLHTIGADNYCVADRHWLRKMGIEVHLSFD

SEQ ID NO: 8373 - protein, 261 aa, Lactobacillus casei
LAFLWLRLPKKRVVLAGVIALSICALQMIQLLKPIPAGNSPYTRWLSIDPFSFLPIIFFILLPLIASIPAGTLLKNDVDSGLFAKVKLQSPLQKVMWSYIGIAFLTGFAIIALALLLNLAVYFTVLPNIKPDNLLNSNILLINQNTLLVSLYYAHPLLHAAISILFASIWAGLFSVFVTVTAIWIKNAFVAMSLGLVAQIVVLMLNSFIKLPNSVSYSPADFLHEMSPTANVNLAVTGIVTLLMLIYCIVFSQIGVKHLVP

SEQ ID NO: 8374 - protein, 226 aa, Lactobacillus casei
LYRNVIRQQNLLTHAFLKIHVVCAVITLIISLIDGNSLTQELMSPENLIVIIFPRYLIFCGLIPTYLLALLATTQIRSQDILIYQSRKVVVLQVLYRLCLITIIMAGVWTVGTVLIMTVSHHFYFLAAIWLTILVRAVYLWTACFLLGMIAITLTFATKSKLIAFLISFSISALSFYLATATMPSLFFDFTGADTNFVLLGKETIMLGATLFFVAVMTQIIGRRDL

SEQ ID NO: 8375 - protein, 239 aa, Lactobacillus casei
VWRLFQNQFFFYWHIIRIRLLFWLIFMNLAIIILTFQIAGNPHTSVINLFFDGTSYAMVETHHVILPVLWFVYFFAPLLISLNSFKQLWQARTMHLRGLKIPPRQFANVNLLLLGFITTTYCASTMTSTFLASIATSRAGLSTTPGTFSELLCLTWLGVFTLLLIQTIGNRFNPPLALIVPATILIATAYTENRFNPFSFLMLSRLPTTGTWNAILIWLGIAIAMTLGYVIIDRNIKLA

SEQ ID NO: 8376 - protein, 211 aa, Lactobacillus casei
MTFIELHQVAKVIKHRQLLHQVNAKIDRGNIATLEGINGSGKTLILKALLGLISVTGNVTVAGKTVRTQDAYPIKAGILIENPSLIDDFTAAKNLELLARLDPNIQSSQIQDLLTYFDLTRFPKQKVRKFSLGMKQKLGIAEAFLGGYPLIVLDEPTNALDHDAIGKLVQLIHDYHVKGATFIIASHDHDFVEEVATQKLLVKEGTISDAH

SEQ ID NO: 8377 - protein, 174 aa, Lactobacillus casei
MRTKHKLWLTTFLVLILVMSIGIFRYHEVNANPKSLGVTKEVFIQQNQLIHAKNVDFMIRSAHVSKSKGQIIVPVELTIKQPGPADYGYKKNNPNFLENMWLNIPYSISTATADVTDKDNQRIHKTEHLLAAKQPITLHFMTTQENYALRNQKMRFSFLVPVSNHYVKYSLLLE

SEQ ID NO: 8378 - protein, 61 aa, Lactobacillus casei
MGSLKKLFIAVFAYIVVIALSVLVQVVMKVPNLLFYIVLVATFVLFTYITRYVTKAKNAVK

SEQ ID NO: 8379 - protein, 57 aa, Lactobacillus casei
MTLLRKIIWVVAFVIYGFVLFAASYYGNSAFLLPVIVVPAIFSGIFWLIENAKKNKK

SEQ ID NO: 8380 - protein, 199 aa, Lactobacillus casei
MTDVTATALLLGGLLYLEWQQQRQLQIKTKSSWLKVVVAIVAALLIVALFWSANTVSNLRLAILAILVASVGLYRQGLGKTKVITYGSVAHASDYRRYDRVITETIKQGTMVTFWSKKGGSYSLMFDQSEAQIRQFFKENLPQNVALLTAEEWATLENRDAQDDRQRQADMLAAIRNRPQRNRLPWQKRERRSEVTRKG

SEQ ID NO: 8381 - protein, 381 aa, Lactobacillus casei
LKLSDIKVYKVKPRWIFVKLSTDEGITGWGEMISGTKTETVVAGAYEMGKKLIGRDPFEIERLWQEMHRSFFRGGPINGTIISGLEMALWDIKGKALNLPVYELLGGAARDRIRVYSWIGGDRPSDVAEQAQARVDKGFTAIKMNATSELHYIDSYNKVQAVVDRVASIRDQVGDKLEIGIDFHGRVHRPMAKVLAHALEPYHPMFLEEVVLPENWDSFDDIAREVSIPLATGERLYTRWDFKNLFRQGAIDIVQPDVALCGGILETRKIAAMAEAFDMGVAPHAPYGPVSLAATLQVDACTPNVFIQEQSLGIHYNQGFDLLDFVKNKEIFQYKDSYVQLPKGPGLGIDMDEDKIKEVAQEGLVWNNPSWKNYDGTIAEW

SEQ ID NO: 8382 - protein, 458 aa, Lactobacillus casei
MNIVMDVFNWLIAAGPTVLLPVIITIIGMIFGLRIDKAFKSGLTLGIGFAGIKLILDFMTTNVGPAAKAMVERTGAHLTALDVGWGSIAAVTWASPIIAILIFAILAVNIVLLIIKRTHTLDVDIWNYHHMAIVGVMVYFVTKNIALGVGSSIVMALVTFKLADWSQPMTEKFFGMPGVSLPTVSALSSLVIAWPLNWLLDRIPFMRRNKFSIRDAQKYLGFFGDSMIMGLLIGMAIGFFAGYNLMKIMQLGVSMAAVLVLIPKMTSLFMEGLMPISDSAQKWSEKRFKGRKLFIGLDAAVVVGNADVITTALIIIPLTILMALVLPGNQVLPFADLAVVPFRVALVVALTNGNLLKNIIIGLVVTASLLWCGTSTAPVLTEIAKSVGIKLGANSLYISSFAATSMIQSFAVYFAFTWHPLISIPVLLIIFAGVWYFFDGIKHVNAAMDAQNQKSAQA

SEQ ID NO: 8383 - protein, 95 aa, Lactobacillus casei
MAAHILVACGNGIATSTVVASKIKSFLAEKGVDVETTQTKLMEVPGKVENYDLLVTTGQFEGQTHGVPYIHGLPLLTGVGAQETLNKIYETVKDK

SEQ ID NO: 8384 - protein, 154 aa, Lactobacillus casei
VAVDLVIDKKLLLPHLEAKDNLDALSQIADNLFAQGYVKEGYKQAILDREATYPTGLPSPRPTVAIPHANYQLVKKTTISVATLAHPVKFHDMGDVNNVLDVDVIIMMAIGEPHGQVEMLQKIVDVIQDDQLRHAIADAADVDGLYQLLAKTFE

SEQ ID NO: 8385 - protein, 208 aa, Lactobacillus casei
MELSEYPTFTVIMRGYTPEQADAIMQAMAGFENQFGVEVTMNTPHALDIIENGNAQYGDRIHIGAGTVTTLDEAKAAIAKGAKFMLSPIEFTDDIFAYAKAHDVITVPAAMTPTEVHDMFEKGADIVKIFPATTVGSDFFKAIQAPLGKLPLMAVGGVSLANAKDLLTHGTSYLGIGSKMFNAEDLANRNVDGLAASMQAFVDIKYAL

SEQ ID NO: 8386 - protein, 681 aa, Lactobacillus casei
VKKRNLQILSEIIRHPNLKSGDLEKQFKITRRQLSYALAQINQELVDHQLPKITRTPRGEFVTPSEVADFFNVQATEAPQPYVYREEDERILLICLYLLVSDELLSLVHIYDFSGVSRTTTSADLKAVARFLEERQLTLKYTRQAGYFIAGSEQVMRNLLNYLVTQLLTFDDGRSSIEQLGKVPTEQIIHFIHKIENVRNVTYSDESFSFLMLAVLMNVTRNLSHRAKDTPYFEHQISDTQEFAQLKPLIPQSWLTSDSDAEWLVILLLSANTIRGDVGVADQALVAAIRTMVAKFEQQTFIKVADQDDFVKRLLAHLRPAIFRVRYGLHLRDIGIGQVMAADPRHRFLVDTIDAIIEPLEKLTGKTIPEDERNLIAFYFDGELEKSADLHVSKERAAVVCTNGLIVSKLMIQNLRRLFPEISFLSATSAREFEHFSGDYDLVFTTVPLKTSARQYIIHPLLSEDEQVQLRYRVLNDIGVKNIQTGISALTAIVRKHAKITDSAGLDHALRRFLADQGVEELPEVHQPRLSALTAPNLIQIGQSRDWQNALQQAIEPLERLDYVTDPFRQTLIDETAAADNYSFIGTEVAIPHTVPENGVLNNGFAFYILKQPVIYPNGFHIRMIVPIAVKDTDQHLQAIQELSEIIADTTTLKQLFAAKSGQQAYEILQHYESKSGANLK

SEQ ID NO: 8387 - protein, 398 aa, Lactobacillus casei
MKKGFKIRWVSWLIIASGIFLSLMMKPQSVCASAETPQPQKTFMVYYRAWRDQAMHGVNTTILDPNPQSMLDLPYGIDIINVFSYVPAGQEAKAQPFFDRLRTIYAPEMHRRGAKLVRALDYGRMVDGLIQQYGQHPTASEIDDYVQTLIYELSGQWGLDGIDIDMEQYPDAKKVALSDRIIQTMGQYLGPKAENGTLLIYDTNGSYLAPFENVMGYFSNLGYQQYGSGPSRTEKMRQTYTAAGFPQNRLLAGLTFPEEGDHNRWYDTDPNHFLRSNMHTVATFSRENLGGMFVYAVDRDGRTYDEPDFSHIRKTTYRWTKTAILETKGYPLNEIKAAAYRHLKKIAPRISPIQYQLLYRQINQATNAFEVNSVFMKDDFNGAVDPTFDAVKEMQMDM

SEQ ID NO: 8388 - protein, 108 aa, Lactobacillus casei
MNEQQQLVVMQLIMAGGNAKNAAFEAIRAAKVGDFKQAKAKLKEADHFLADAHQAQTGMLTAEANGQHQAVSLLMVHGQDHVMTAITFRDLAEEIVALYERLGEKSAS

SEQ ID NO: 8389 - protein, 104 aa, Lactobacillus casei
MAENPKTIMLVCAAGMSTSMLVRKMMDAAEQTKANVKIFAASAADAKDKLAAEHPDVLLLGPQVRYLEGDFKAALSIPVAVINMSDYGLMKGDRVLQTALDLMA

SEQ ID NO: 8390 - protein, 466 aa, Lactobacillus casei
MAIQFAADFTWGAATSGPQAEGTFHKKHENIFDYHYHTRPQDFYHNVGPDVASNFYNDYEQDLKLLKQAGIQALRISIQWTRLIDDLEAGTVDPAGADYYRLVFDAMHALGITPYVNLHHFDLPIALQQRYGGWQSKHVVDLYVKFARRCFELYGDQVTHWFTFNEPKVIVDGQYLYQFHYPNLVDGKAAVQVAYNLNLASAKAVAAFREVNQHPDATIGTIINLTPVYPASQSAGDRDAARFAELWANDLYLEPAIHGRFPEALVERLRQDHVLWASTPEELAVIAANRIDVLGVNYYHPYRVQAPDVAPDSLQPWLPDIYFDEYKMPGRKMNLDKGWEIYPDALYDIAMTIKNRYGNIDWFVAENGIGVADEERFLQDEVVQDDYRIQFMTDHLRFLHQAIEAGANCHGYFVWTGIDCWSWLNAYKNRYGLIRNNLRNQTKSLKKSGYWFRQVAASGYVPDADS

SEQ ID NO: 8391 - protein, 297 aa, Lactobacillus casei
MSLAVIDIGGTTIKFGGYSAETGLFQQTKVATPKTLAGFYQCLQQQVAALRLTTEVTGVAISSPGVVDQTAGIIRGASAVPYIHHFPIVTELTNRLELPVTIENDANCAALAEVQAGAAADVRDAIFLVLGTGVGGAVILNGQLHRGRHLMGGEFGYMWHGDDDSVSRLGTLVNTVARYNRRHGTHLDGKTLYEQAHKGGQEAKKAVQRMFHVLATTIFNLQYSFDPDCFVIGGGISQNPHLLADLEAALDAVMAQTELAPVRPVIRIAKFKADANLYGAAVHFQQSQAGLSRLERK

SEQ ID NO: 8392 - protein, 430 aa, Lactobacillus casei
MAEKSALAAALTEYAEAHPLPDTATQTMFRTLLPDALVKATRRQPDGTYFVATGDIPAMWLRDATFQVLPYVQLIKDIPDLKPILAGVLRRELAFVRLDPYANAFNETASGAHWRADDESDRPMSPQVWERKFEIDTLCAPLLLAVNLYAETGDASIFDIDFWATFTLILTIFEQEQHHERSPYFFRRSDTDENDTLPNNGLGNPIGETGLIWDGFRPSDNRCEYGFHIPANLLAKTVLTHLLPLMPVDERLLAKRTQTLVAAIEQGVMTYAIQTLPSGEQGLAYEVDGLGHARLIDDANVPSLLSLPFLGAIAVDDPLYLTTKAFVLSPQNPYYYKGKMLAGIGSEHTPPEYVWPIAVAMEGLVATTAADKMAKLLLLVATTGGTGQCHEGVQKDDPLQYTRTWFSWANMTFCQLALDVIQQQEQEGLR

SEQ ID NO: 8393 - protein, 879 aa, Lactobacillus casei
MQKVHVIAHTHWDFEWYFTRQQARVQFAYHMAEVLQALETNQLDAYLLDGQMAIVDDYLQTNPEQRDQMRKFIQARRLFVGPWYTQIDEMVTSGESIVRNLQLGHKLAADLGGVMKVGYLPDSFGQGQDMPKIYHGFDISSTVFWRGMPHEKNARYFYWTANDGSKVLAANIKNGYYAGVELIENDDVASLLHRIATDTQAHDLALPVGGDQRAVDFNLKDRLQIANAQQDEFDLVEDNYPDFFKDLAKTPDLPTYQGEFVDPSASKIHRGIYSSRADLKELYDRLEHLMIDVVEPLMAVATHHGIEAQSGIVETIWKSIARGQAHDSSGGCNSDETNRDIAQRGVDALQLAESLRDYLLRKLASNAPDSLNVFFWNPTIQPVHQTGQITVATREPHFNLKNEAGEPVAFEVLKQEQVDNAVLRGDPAQETPDIYYRTTIAVPVTIDALDWVGLTLEPAHQAMPLRTKSTTIRNGVYTLTFEDGKLLLTDHRTQQTFVDPLHFEDGGDAGDTYDYSPPDEDWLLDLSLSHAEVTGHQGELVSDLIFRGSWQLPGKLADRKAQKADVVMPYTLVLQLAADDPVIRFDLTVENTVSDHRLRLVLKTPIKAKDSYADTPFGVAMRPVIDPHLKDWQAIGYHEEPTALRPLIHFANSHDQKTSWTFLGLGEKECQIVGEQCDQLAVTMFRGVGYLGRPDLKRRPGDASGLQTRYVPTPDSQLLGTRHMRGGICLDTTFDPVELQRRVQALAIGSLGYQNQTIDRFTTPLQYFPINANQTPLRHHSAIELIGSDLVVSSVSATSDGTGYLVRLYNPTDQTCTEAATLHFSQPASVRLLNLNNEVRQTVATDVTVFELPAFKPGEIRTYGIYPRQSPSVAEKEHA

SEQ ID NO: 8394 - protein, 442 aa, Lactobacillus casei
MMKFNVDKLQEPLLKASMWVQNNTILQAVKNAFVRTIPFTVIGSFSNLIKMQLDALIKSQHLNWGWLTSLSQLFGYLGVATLGIVGLIVVVSSAYSYAVELKRRDENKGMNVIIATLLAFSAYFVMVPNNVNFADPKAKVIEGFAASLFSYEGMFTGLIVGMLAVALFASFSRSKFTIRMPGSVPQNVFDSFFALIPMSEVLLLFGLARIGLQAMGYTSLIQLISTVIIKPLLTVGTGLPAIIVVILLEQILWFLGLHGFNIVWGIVSAFWLPLFLQNVAKFAETKSFAGISIAPNTMTNVYAMIGGSGATFGLIIAMLIFTKKGEKEREVAKLALVPGCFGINEPVIFGLPIVLNPIMFIPWIFVPLFNAIVAYVVTSIGWVVPLVVLNSGNEPIFVSTWILGGLHMSPVILTAVLVVIDIFLYAPFVIMNQRSERRLATA

SEQ ID NO: 8395 - protein, 242 aa, Lactobacillus casei
VLYLYSEIYSDIKKDILTNHYRAGKPLPTQKKLAETYHTSRLTIKKALKLLQDEGLIYSQQGSGSFVRARATEDDKELLPLDAPIGATYSHRDQNISSKLLYFDARLPNETEQKNLAIKSNEPVYDIKRVRLINDRYYSLEHTIMPTSIAPLDKDILKGSIYDYLGNRGIQLTDARRILYATEADAETADALDIKKGSPVLVIEQTAYDQKGHAFEYSVSRFIHDHSRFVLNIHRKLPDFLG

SEQ ID NO: 8396 - protein, 242 aa, Lactobacillus casei
MTEQYVFEEERKDLAAVAREMFVRKNTNVAGGNISVRITADKDFDYGSIHIKAGKDYLIMTPTMMSEAWYAKLQPTQILVVDLETGQQIDGVGRLTREINMHEEAYRANDKIRCVYHSHAEESMFWATAGLDMPNVTEVTGEVGPIRVLPYAPACSKELADTVYNGLKEVGDAAKEHIFLLNSHGVLITSEDLHHATEILETVEWNAKIAYQQTVFMKLGLLDSYQSCGKATDGMLKQPLKA

SEQ ID NO: 8397 - protein, 78 aa, Lactobacillus casei
MSKTSASLLVFLDTIGVSIALLGGNTGLCLLMGLITLILYRKVNPILFGDYDRKREKRLAQRHKVLLAQRANNGGNTK

SEQ ID NO: 8398 - protein, 528 aa, Lactobacillus casei
VTILKDVVNYILNLGGPVFVPLIMLILGLVAGLKFKKSIVAALTLGVAFSGMTLVVNYMMDAISPAAKSMSKLFHLSLNAIDAGWTGVAAITWSYKSAFLFFPLLLAINFVMLTFNWTKTLNVDMWNVWNKIFTYVVVLYFTHNAFFGFLVAGIQIVFELKAGDMWHRHIEDLTGMPGVTVPHFITLFAVILQPLNKLLDFIPIMNKPFDADALQKRIGVWGDNTVMGALIGVLLGFGAGYSISGSLNLAVKAATAMTLFPMISKLFMTALQPIADAMSGFMQKHFKGREVYIGLDWPILAGRNELWVTVIILVPIMLIFAMILPHNTVLPFAGIINLSFVIAALLLTGANLLRMITLGIITTPIFLYGATYFAPVITNLAKTTGTVKVQAGQQLSWSTFEGPDFRLFFAQAFNGKWWAIALAILWTLGFIWLYRDQNKIKLPSQRYGTLAPATAAAAPAVSDTNDNADDVDLNDLSGLDFSDAKASNESKKTSSPQNNEADNVDLNDLSGLDFSQTSHEKNKGDKHE

SEQ ID NO: 8399 - protein, 106 aa, Lactobacillus casei
MAKIVVACGSGVASSEATASRIKDFFESHNVKGVSVDATDFKQLPEVLHNYDVYVWIAKPNQQLEDLAKENHIAVVNGMPIFMNMNPEKSYKQIIQALKNMQNAGK

SEQ ID NO: 8400 - protein, 159 aa, Lactobacillus casei
MDYSTMIHKDLIFLNEDAADRKRLFRDVAKKIQAAGYVKDTYEAALNRREDAFPTGIVFPEISVMLPHADPVNVNRPFMAIVKNAQPIRVLQMGYNEPEDATAMFFLGITDSSQQVGLLQIFMDLLQNGKFVAKFKAINDPEAMYEFFVNTFKAQVAGK

SEQ ID NO: 8401 - protein, 260 aa, Lactobacillus casei
MSQSPAKFERLNEIIQILRDTPQISIADLSKQMFTSKSTLRRDLIELERSNIIRRQYGMIQLLQGNNLEFTYEKRRNENARLKRLISRQIAARIPSNAAFFIDGSSTFFSLPELLHEQVGLHVITNNVNMGLQFNSLNNVETIIAGGKMVPRTATTLGSTTIREIQSFHPDFALLSTGSIDADGIYVADPEQAAVKEAMIDAAKCVIFGIDSTKFDQSDYIRITNMDQINEIVTDKQPSSAYQPLFENYHIQLTYPHQNH

SEQ ID NO: 8402 - protein, 296 aa, Lactobacillus casei
MDNKKQFLNPEYTQSFTESPYVTQMRKVTWNLYQHGWDERNGGNVSYRLTEAEIAPYGDVHEVKRNIPIKFDASKLAGQYFLVTGTGRYFKNVKDFPARDTGLVQIAQDGHSVNLLWGFNDGGQPTSEFPAHLMTHIQRLKVDPNQRIVMHCHPTNLVAMSFTLPLEEKLFSRILWKMQAESIVVFPEGIGVLPYMTPGTNEIGQATADKMAKFRLVMWPQHGIFGAGDSIDETYGLIETVEKAATIYTAIQAQGGRIINEITDENLEQLAKRFDLTPNPEFLHGDTLISKVTLKV

SEQ ID NO: 8403 - protein, 426 aa, Lactobacillus casei
MVKPEEVDKAYEVAKQRYAEIGVDTDAAMKELEKVPLSVHCWQGDDIHGFLFPNQALTGGIGVSGNYPGIARTPDELSGDLHEALSLIPGKHRVQLHAIYAVTDKKRDLDTLEPEDFDYWIDWAKQEGIGLDFNGTFFSHPMVKDNMTVSSPDPKVRDFWIRHGKISREISNYIGEKLGSQVVNNFWFPDGFKDNPIDKKTPRLRLLKALDEIIKDPLPEKNTIESFEGKLFGTGIESYTTGSHEFYQNYAISRNKLWTIDAGHFHPTEDVSDKFSAFFPFGKGLFMHVSRPVRWDSDHVVIMDDALIRITRSLVRDGYLDRTHIGLDFFDATINRVAAWVVGARATQKSLLQAMLAPIDQLKKSELNADFTTRLIETEELKSFPFGAVWDKFCQDHNTPVGFDWMNNIHQYEKDVQFKRDTKLVH

SEQ ID NO: 8404 - protein, 104 aa, Lactobacillus casei
MARIGQVMYVYPDKYDEYEKRHHELWPEMKAALKEYGATNYSIYLNKANGELFAYLEVPDVDKYNQIANTDICKKWWAYMEPLMKTNPDNSPVAVDLHEVFHLD

SEQ ID NO: 8405 - protein, 496 aa, Lactobacillus casei
MKAYVAVDIGASSGRLMLGAVVDGQLKIKEVHRFKNGFKKENGHDRWQIDHIINEIFAGLEKVKKMGYTLIDMGIDTWAVDYVLVGADGKKMHDPVSYRDSRTNSAISKLTSELPKSYIYEKTGIQFQNFNTLYQLYTEERDDLAKADKILMIPDYIGYVLTGNAVTEVTNASTTQMLNLRQGLFDKDLLKEVNVAQDQFPELVESGTPLGKISHKWHMKYDIPDTDVITVATHDTASAVVGTPGLGDHWAFLSSGTWSLLGAELNTPENGQDAFKENYTNEWGAYGTYRFLKNIMGLWIVQCIKRELKDQYSFNELAEMADKVAPFRVFIDVNDKRFENPKSMIKELQQYVAETGQAKLETPGELTRAVYENLALYYANEIQKLSTIIADPIDTLNIVGGGSNVALMNQLTADLAGIKVIAGPSEATAIGNLLVQMITTGAVKDVVAGRKLIRESFDLKTYQPNATAYPDVLTKYKAFMKTAKPTKAAAKSKEAV

SEQ ID NO: 8406 - protein, 454 aa, Lactobacillus casei
MASEKSSLKSTVRVSITNFLDSGSIVAGASGLTLWTQHFGLSSFQVGLLGALSANAFGAALGALIGGPLSDKFGRKLIYTYDMLVYMLGTILVMFAVSFPMLLTGFLITGLAVGAGVPASWTYISETSQNDNRAKNIGVSQFAWSLGPAVIFILGTILAPMGLLGNRILFGLLTVIAFVAWLLQRGLGESKAWQDRKAFEKSSGQKSHPYRTLFSNKTSLKWLFFLIGVYMFWNLVAGAMGFFMPYVYETAGGLSNQEANMLQAVLWILTAVATYFGFAKYGDRANHRIFFFVGAAMAAASWIILTYAGMAQSWSLWAFVALWGISAGIGAQAWYALWATELFPTQFRAGSQGVMFFVVRASAGVWSIIFPAILSSLGFTVAGTFMIGLLLVSLVIGTIWTPKTRGKSLEEITREQCGDKFLTDDEKAKADRDTAAKDKAAGNSVAQQMMNPDK

SEQ ID NO: 8407 - protein, 340 aa, Lactobacillus casei
MELSVLKQLESLTTIEKQQKNRQIFSDDIPPTAIDLQESKEFNVPVLNDYFFRNHAIYVSKHNRFAPYPMHTHQFFEMNYMLQGNANETVNGDRVHLSQGDLLLLDIGSEHSIDALGENDILINVLFRDRNISLDFLNQIQSQQSVLYDFMINHLRKEKTEKRYMVFRSGMHDIRTSLERIIEEYFRPRPFSDTIIQAELTVLIAELIRGNEPTIDDPSPAQKLAVKLLNDIHKHYRDLSLEDLANKYAYNKNYLGNLFSKEVGKTFSEALTQERLINARRLIQNTKKPISEICLEVGISNKSFFYHKYHDLFGNTPKDDRQHTNGYISPSHTNPPLTIL

SEQ ID NO: 8408 - protein, 373 aa, Lactobacillus casei
MKITAAVVDKKGADFEIRDDVELAPMGPDDLQVHMVATGICHSDEALRIGDAVIGYPIVLGHEGSGIVEKVGPEVTQFKPGDHVVLSFYACGNCKNCLRGIPTQCLNYAHNNLSGTRPDGSAHFTENGKPVADMFDQSSFTTTTVVRERNAVKVDKDLDLRKLGPLGCGYVTGSGTVLNTLKPKPGDTIAVTGTGAVGLAAMMAGKISGCTKVIAIDIVDSRLQLAKELGATDVVNSKEEDPVEAVKKLTGGLGVDWAVDTTGVKAVMEDTIQMLAQGGTTATIAVTPHHIDVDTWNDLCVNDKKIVGVNMGDSIPQIDVPRLIEFYKQGMFDFDKTEKFYSFDQINEANADSRSGKTIKPVLIIDKDYVPGK

SEQ ID NO: 8409 - protein, 487 aa, Lactobacillus casei
MDTVTKDAIVQQLIQLTSHDQVNVDPDQLNYASLDFYRKYPRARKIYQAPIPVAIVYPENVEQVAAVLKYANDTGVNVIPRTGGSEIERGLESAREPHIIVDGSRLNQILKFDPEDMQLTVQAGVPLKQAEDWLNEKGYTTGHLPQSQPLADFGGLVATRSIGQLSTLYGGIEDMVVGLEAVMPDGRIVRIKNVPRRSVGPDIRHVFIGNEGSIAFITEVTVKLFPYLPDTYHYLAYTVDTMREGFHLLRDIVAAGYRPSVIRLYDAQDWSQFYPKHAEKPVLIFRTEGPQPLSDATAGAIKAMVEASDQTQPYEPLDEIIDWFKHLTWTQKEVDAEVNQLEKTPFVGFTTEVAANWHEIANIFEAVTTRVKKEIPNLYGIGGHSSHSYVNGTNLYFVYAFIDAEDDPAGEMARYHDPINKIIVEETLKRGGTMSHHHGVGKARAPFIKEEYGSSYWVLKTLLKSFDPKNTMNSGNIIPLEFWDEPD

SEQ ID NO: 8410 - protein, 489 aa, Lactobacillus casei
MDRYILAIDQGTQSNKLTIFDLQGNALWQEHQPLKPLHTAAGGVVEHPDDDLWTSLQTASKALMAKFDGDVNEILAIGLGSIRFNRLVLKADGDLAQPAISWMDDRAHQIYEKTTDDAVYVTASTGYLAYRLTGNRIDTAASYIGTWPIDMDKWDWTDEDMMFDFLNLPRTSLFKLVKPGGILGNVTEEAAAVTGLPKGLPVIATANDKAVEALGAGLKTGPDLLLSLGTYTTSMLQGNENHPFGTTRYYWTNFADVPNEYLYESNGVYRGMWTVSWFAKQFQGIGDATHESTLDVLTREAATVPPGSDGLLTILDWQPAADRPFRKGAFIGLDERHNRGHMFRSILEGLAFNLLDYSTAMLKELDRKVDRLVVTGGGAQNDIFMQLIADIFNLPAQRNVITDAAGLGAAINAAVGIGEYRTYDEAIAAMVKPADSFVPQADAVAQYAKVYEKYKNLHQLTDPVFKDLQTINGVAERGKVGEPLIASWD

SEQ ID NO: 8411 - protein, 186 aa, Lactobacillus casei
MQLQDVVAANPVIAGIQDDKGLNAALTADVKVVFTLYGSILNIGDIVAQLKAAKKIVFVDVDLVEGLASRPSAVEFIAKTTDADGILSSKGHLLAVARQKKMLTVHRFFLIDSRTLYTMQRQYDVGHADMIDVMPGIMPQAVSWITHETDVPLISSGLISTKEAIMADLAAGATGISTTNTTLWQN

SEQ ID NO: 8412 - protein, 372 aa, Lactobacillus casei
MQIDLPKIFISPSNYIQAKNILFNADPYLSRYGSKAVIVGDENVYGLVGDRFIDYLKDNDYTVTKLMFGGEASPEEIQKAIDEIKDTPDFVIGIGGGKTLDTAKEIGQHLNIYTVIIPTLASTDAPISRLSVLYNEDGTFNAYQFHTKSPDLVLVDPAVISQAPPRFLASGFGDALSTYVEAKAVGDIHGFTNAQGIGTITAMKIAQASTDTIFEFGAQAFEANKAKVVTPALEAVIEANILMSGLGFESGGTSLAHALQNSFPALKKGKHLMHGEKVAYSLLTQLLMENAETEVINHYLHFFLQVGLPTTLEDLGWEDTTDDELMLVANDAAAAWTGIDQLRFDTSPEAIVAAMRAVDQYSKDYQAHALAE

SEQ ID NO: 8413 - protein, 72 aa, Lactobacillus casei
MAKFSKDTKLSELLADKRYMKVVDKYVAGASTNPGVVMVKNLSLEQLIAIPQVHSDEASMNKLIDELNETFG

SEQ ID NO: 8414 - protein, 29 aa, Lactobacillus casei
MLANTRLKVHQLLAVKTSFGTSHKTGIGA

SEQ ID NO: 8415 - protein, 61 aa, Lactobacillus casei
MFQYIYRLLVISGLAFVAYFAYDAHVFTPGKKINLKRDLVLGLIFLVLLFVTAYVSKFVNK

SEQ ID NO: 8416 - protein, 268 aa, Lactobacillus casei
MFKHTRKLQYNAKPDRPDPLMARRLQESLGGQWGEVTGMMSYLSQGWSSTGSEKYKDLLLDTGTEEIAHVEMISTMIARLLEGAPIYAEADAYKSDPALAAVMGGMDPEHAIVHGLTASLNNPNGAAWNAGYATSSGNLVADMRFNVVRESEARLQVSRLYYMTRDEGIRDMLKFLLARETQHQLQFMKAQEELEDKYGVVVPGDMKDIEHTKFSHVLMNFSDGDGSRAFEGQVAKDGEKFTYQEDPEAMGGVPTFKPADPHLHNDQG

SEQ ID NO: 8417 - protein, 561 aa, Lactobacillus casei
MHKSWWQEAVVYQVYPRSFQDSNGDGVGDLPGIIQHLDYIKQLGANVIWLNPIYKSPNADNGYDIADYQQIMPEFGTMADFKRLLKEAHARGLKIMMDLVVNHTSDEHPWFQAAKQSRTDPHHDWYIWRDPVDGHAPTNWRADFGGSAWTYVPEVGQYYLHLFAVKQPDLNWQNPAVRDAVFNMMTWWCQQGIDGFRMDVINLISKPDVFEDDPHLFEQPNGNSLGLIANGPHVHDYLRAMNQKVLSKYDLMTVGEAPGVTPALALKYTGFDRHELEMVFQFKHVGLDNDPQFGKWSLHRPKLTDLKRVLSDWQTALHGKAWNSLYWDNHDQARAVSRFGDDRPAFRVRSAKMLATTLHFLEGTPYIYQGEELGMTNVAFPSIHDYRDLDTLNAWHELVEQQHALAPDDMLKRIHRRSRDNARTPMQWTAEIQAGFTRGTPWLAVNPNYTTINAASALANPDSVFFFYQKLNRLRKQYPDLIVYGDYTLLDPDDAEVYMYQRHAADQELLVVSNFTDQTLTRNIAERQPQAAQLLISNYADDAGDTLRPYEVKAYLGEQRS

SEQ ID NO: 8418 - protein, 50 aa, Lactobacillus casei
MIKIYTEGGVSLSVADALMLMLTFAMFTLALAAFIIDVVKAILDNQKDRQ

SEQ ID NO: 8419 - protein, 759 aa, Lactobacillus casei
MKRWRVTQGKVWVFLVALLGLAVMINGQAPQRSLAAGPRTFYVANNGDDNHDGLSVDQPWQSLEKVAATKFQPGDRILFDANSVWNGQLLLDGAKNGEGTSTAPITIGSYNQGSTGKKAIINGLGTTANKNPYHERKLSNLNLMTGTVELWNANHWTISDLEVTNTAGDGNRQGMRIGILVASDIQTAYPSGNDAAAVQQKLAIFKASHRTGITITNNNVHNVDGAYQSDLIPDQTGKMVAAGKNSGGIIIVGNTDVTATHNVITDVANEGLRNDANASVLPGGWDQYSFQASAKTIFRHNYIRNSAGDGIVISSSENGTAEYNTVQAANSMPNSKNAAGASKNFAGLWFMGGEYNLAQYNEVFDIPNHYLDGAAFDFDGFASKGVYQYNYSHDNSGGFTLFMGDHQTDNVFRYNLSVNDVKDVPSPALNHLIFVVSGKADGIDGFPLFNNNTFIVGKAVKNLMISNNGQTGIRFVNNLVYAPGGNVPRFVVNQNGTKRPVFTEGRLDHNLFYPQALMDESHAGTVDVSGNIFADPQLVDAGAKPSGVIQQADGTFDRTGLAAFIPQAQSPAANAGINVDELTPAAVREKFPISQDFAGKPINLQHPTIGAFEAAEAVPVVQKDNLKKLIDQALDAKKTDRYSLASVVKKQAFDQALQEAQRILADSQADQSAVDQAVKALQTALDQLDGHQDAEASSASQEVSSGQKTGDDKKSKQDHEDQSLPQAGDLIFKSLPIIGGVILMSVVIGGLYFKYVREK

SEQ ID NO: 8420 - protein, 331 aa, Lactobacillus casei
MKKMKAKRWKWVPLFLLGILANLIGGCDVLKPADALSVAGTPMSAKVYRLFLQNEKALTVNRYVTKYHAKYDARFWQTKYGRQTPQQAAQIQAMNKLKQFVIEDRALVKAKLLTKPLAEFDSLKKTQGTGADLAGMAAAQKQHRELMLKLQAQYVKANRKSVTGQRQIAFYRQNKSKYWARPDLIHYETLTFERGKIGNLSEFTELVQRFNGQQTDLASVQKAFVAAGFHGQLGQNDSLHDADQYYGAYLRATNDQTGHVGQIFAAWLSDQKMSLVRVTSAAKGGFTPFSDVKEDVTAKILQAQLAKTLEKRAKQAGVQGDPAQLAKETFA

SEQ ID NO: 8421 - protein, 597 aa, Lactobacillus casei
VSYTMNPITWQQTPNGDPEWLYMLKRQEYLLDLLEAYYETGRIDYQAKMKALLFSWIDENLAAPATWRTIDTGIRLLNWTAVVANLLEDHQLSKEEQARIEEAVNVQAAYLQQNYTEKFDISNWGVLITTGILVYAARFPKVLPPTIVQWAQQKFETELDLQVDAQGMQWEQSPLYLLEVWRSTLAVIAAQQQAGVAVAPIVLTKARAMQRMITQYVKPDLLLLQQGDTDAIRIDSLYNASAAILQQASPLQQRLAPIVDFGLLELAHQQWQLSAKTETKTPLPKEFAAHTSGNYFWRSDWGQHADYWHVFNGDLGSGHGHAALGHVDLTIGGHDVLVDPGRYTYVDGTERRQLKSVAAHNTVTLDHSPFSLPNDSWKYRYVATPLNHSLVDFAGGQVVKLTFLDQSQAVPAVITRLLISLSHERLWLIVDMIHHPGQHSLKRFWQVAPQLIVTQHDTGYQLGDIANFAMSDDQVWASQQLFSPRYNTLEHLTRLESEMMFTDFTVQAAVLSPRQQPVTIMPIAAQQSGDRDAVVPERLASGFRVDLDNRRNFLLTLQPENTIVGRKLYWFDGTEAYGSLNIFERQGQQVAQHFQVF

SEQ ID NO: 8422 - protein, 116 aa, Lactobacillus casei
MTIWQIALIVLLVIVCALYLVAIPLAKRSAMRKQAKMVDQMHANLKPGDQIVLIDGIVGKIKHLNQEDVQVEIAVNTVITVKRMGIAGVVKEAATGDGHELDHVHSAVESATASHG

SEQ ID NO: 8423 - protein, 156 aa, Lactobacillus casei
MNYAMAVVGHGRYPEGVLSALKLLIGTTDGMTAFNLDETTTHEQFEQRLKNFLDENDHALVFADMTGGAPHQIVARLMLEQNRPHQYIISSAPLNLILDLYAKNMGGFDDANVDETLRHTVTLSKELIEILPDRMKTNSDEVPVPDIKHEDEGDGI

SEQ ID NO: 8424 - protein, 271 aa, Lactobacillus casei
MASSRKPVLTKKDYLNSILRSYVLQNAQNYGTMQGTGMANSIMPQLRKIYKDDDAEFKRVTTSNLEFYNTNPQPYPFVTSIMLAMYDSGKDEDDVRAIKFALMGPLAGIGDALSQFGLAPLFSSIFASLALQGMTWAPIPFILCLFGITFGVRMLMGYLGWKVGTSIIDTLSDRMAAIADVASMLGLTVIAGLSVSFVKVNLAWQYTQVIKGKTQVVAIQTILDKIMPYMLPIALTYFVYWLITKKKWTIYKIVILLFVAGVLLSVLGILK

SEQ ID NO: 8425 - protein, 269 aa, Lactobacillus casei
MTYSIVQALLVGLWAAFCFAGQQWGIYTNRALFISFGIGLILGDLQTAVVFGATAELAFMGFGVGPGGSTPPNPLGPGVVGTIMAISIQGLKPAAALSLSYPFAILIPFVITFIFSVNANNLAWSRKAIEEGKYRRFHFLANTTLLGFILFAFCFGFAATLSTSALKVFVQAIPQWLISGLTVAGGLLPAVGFALIMSTMVKKEYIPALILGYVCVAYLKMPVIGLAFAGAVLAFNNYYNGRRADKKDHGTNGNDDGSNQDEGGIEDGI

SEQ ID NO: 8426 - protein, 178 aa, Lactobacillus casei
EIIABCMPNENTMTEPNIKAVRLDERLIHGQGRLWISNLGVNLVIVANDEVAKSHIQQQLMSSLMPESVGIRFFSLQETIDKIFKASPRQTIFIIVKTAQDALTLAEGGVPIKELNVGNIHMKEGKTRLTNFIAVDADDLHALKTLHEKYHVDLNTRTTPLGNDVGSDFDLNDYVAKH

SEQ ID NO: 8427 - protein, 392 aa, Lactobacillus casei
LKIENLTNAQRFFNAGIVDRRMVTTALDNVVAHLDLNIKVFGENFPEPSTVNNRYAPMKNTEWTNGFWTGMLWLAYEYTGEQKYRALAEKNVASFADRIDRKISVDHHDLGFLYSPSVVSAYRLTNSQLAKDTGIKAADQLLTRFHQKGGFIQAWGTKGAKDENRLIIDALLNIPLLYWATSVTGDAKYRQVADQHYQTALKTVFRPDGSTFHTYFFDDAGKPLRGATKQGYADDSDWARGQAWAIYGTALHYYDTHDAAAFDSFKAVTNFFLNRLPQDDVPYWDLIFQEGSDQSRDSSSAVIAVCGLHEMLKYLPEADPDKPVYRAAMHAQLKSLIQHYATPVDGQTAEPLLLHGVYSWHSGHGVDEGNLWGDYFYMEALIRFYKDWQLYW

SEQ ID NO: 8428 - protein, 229 aa, Lactobacillus casei
MDQNKLKQEAAQKAAEFVEDGMTIGLGTGSTVYYLVEAIAQRVKEEHLNLTGVATSVRTRKQAESLGIPMKDLDEVAQIDLTIDGADEVDKHFQGIKGGGRAHLIEKIVAINSARNIWIVDETKLVDTLGKFPLPLEVIPFGSGKLLQRLKDEGLKPAYRLNDDGTKALTDSKNYIIDLHLGRIEHPHLLAEWLNKQVGVVEHGLFLDLVKTVVVGTTHGPEILDAHRG

SEQ ID NO: 8429 - protein, 256 aa, Lactobacillus casei
LEQVKPKQQKPYGTVLIKAKDILDYLMKADDPPSLADMSAALSSSKPTILKILNTLDMIGFVRRDESTKRYYLGTELIPYAQKALDSFDIAKVARPFLENLRDETNETINLGIVRNDKIVLVEKLESPNSIKLESIIGGTMNMYSSAMGKALLANYSRKHLDDYLETHKLKPLTPNTITSLPKLRQNLKTIQEMGVSIDNEENQPEVLCLGASIMKAGRIYGAFSISSPKYRVNKERQSNFIRLLLNTQHAIEQTL

SEQ ID NO: 8430 - protein, 266 aa, Lactobacillus casei
MTEITLQLRHEDQTLKTATSETRTYLAYHKQYALGDYYQVRVSDAPAYVWVQLDASVAPSLVYLKQTTWDFRIPFNLQKEWPYPDGAFLGTNHYAWVRVAHEGELTVSRNLALNTYDQHEATGAYPHASANAETRDELVFYAKNVIDGVIANEKHGSYPFQSWGIAERPDAELTLDFGREVLLNRLVLILRADYPHDSYWQEVTVVFSDGSSEKLELKKTAAPQQFDITPRKVTWLKLTQLVKDQDSSTFPALTELEAWGKEAFAK

SEQ ID NO: 8431 - protein, 281 aa, Lactobacillus casei
LSFNMVTRYAHSPEDIKHYDTDKLREEFLMPKIFAPGDILLTYTYNDRMIFGGVTPTDQPLEIALSKELGVDFFLQRRELGLINIGGEGSITIDGTEEPMTTHDGYYVGMGTKHVIFKSNDPANPAKFYVVSTPAHKTYPNKKLPFADALAKPMGDQAHMNKRTIYKYIDASQMDTCQLQMGYTVLEPGSSWNTMPAHTHARRMETYMYFEFAEPDTRVFHFLGEPNETRHIALFNEQAVVNPSWSIHCGVGTTNYAFIWAMCGENQTYDDMDQVPMSELR

SEQ ID NO: 8432 - protein, 274 aa, Lactobacillus casei
MAEIHQTEEEIKRHEAELDHFKMKQFDLTGKVAIVTGGNTGLGQGYAVAMAEAGADIFIPTFGTAEWDNTRRLIEKRGHKVEFMQVNLTEPGIADKVVAEAVDKMGHIDILVNNAGMIRRNPLLESKDKDWDQVIAINLSAVYHMSLAVSKVFAKQKSGKIINIGSMLSFQGGKYIPSYTASKHGVAGLTKAFASEMGAYNVQVNAIAPGYIKTENTAPIRADKARDQEILDRIPAGHWAEPYELMGVSVFLASDAANYINGAIIPVDGGYLTR

SEQ ID NO: 8433 - protein, 438 aa, Lactobacillus casei
MGLEDSKFGQAFVKFAVKLGDEIHLRSLRDAFATIMPLYILAGLATLFNNTVFTWIFKGKTLLQVQYWGTMLSNATLNVSSLLIATMIGYFLAKNRGFDNPIASAMVSMAALITMMPNTVSLIPTGAKKAIDVTGALSFSNMGTTGMFAGIIIGLLATELFIWVSHIKHLQVHLGDQVPPAVGNSFNVLIPIILVLSFFAFVSTVLFDTTSMNLISLITTFIQEPLRHIGTGVVGTIIIYTLANLLWLFGIHFSVIYSSILEPLLIINIVQNTAAYSAGHAIPNIINLSLVQSFGLIGGSGGTLCLLIATFLVSRNKAARNVGKFAALPGVFNINEPVIFGYPIVYNVSLIIPFILLPSIGIFIAWLATTLGWMSPMVIQVPWTTPVFMNAFLATSGDWRSVVVQAVVVLIGILLYIPFVKVNDNVVARQAQEAAKEN

SEQ ID NO: 8434 - protein, 458 aa, Lactobacillus casei
MSQPLPRGFLWGNSTSSMQTEGGWNEGGKGRSVYDIRTATNNSSDWHVAIDEYHRYDEDLDLMANQGMNCYRFQISWSRVCPTGDGDFNEEGIQFYDDLINKLLSRNITPMICLYHFDMPLALAEKYNGFIDRHVVDAFVRYGKEMIKRFADRVPYWITFNEQNLYSMPEVFQISGYLKGPQSDADMYRISHHVMVAHARIANYLHAHTQSKIGGMLAYQEVYPATSRPRDIFYARRIDEFLNRNLLDVFAYGRYSSEVLTFLKRKNIDLDLTEEDQKAFSKLHSDFIAFSYYRSLQINSDHVPINVIPNHYLDFGAEEVPGLPVNEWGWNVDPTGFRDILTKTYNQYHLPMFPIENGIGMREKFNGSMIQDDYRIDYHRRHIQALKKAVFDDGVEVIGYLGWGLIDIPSSSGNMDKRYGMVYVNRTNHDLKDLKRIPKKSYGWFKHVIETNGADLDD

SEQ ID NO: 8435 - protein, 240 aa, Lactobacillus casei
MYKYQTIAQKLRKKFTDGSYQPGDLLPDQESLANEFNTTRLTIRKAIEQLIHDEVVYVKRGAGTFLRKDVHQNKLEASIDKPVGATKTYAGRNVTSKVLELSARLPTKEEQQALLIDANEPVYVIRRVRYIDGEVFAYEHTIMPTKLTTLTQKVLEGSIYKHLAQVDHLRISRSHRIISAAKATADDVKAMCVQLNDPVLVIKQISYTEEGEPFEYSETHFPYQTSNMVADVNINPPDTW

SEQ ID NO: 8436 - protein, 237 aa, Lactobacillus casei
MTKYQEIADNIAQSIRNGEYPDKLPTEADLISRYQAGRNTIRRAIDVVYRSGLLRRVQGSGFYVNHMPATSNAIINLVTRADVAMHNKHQHLTSHVITFDKIKAGSDLAKSLDVSQNSELYRVVRLRYLHAALYCLEEAYFTLQAVPFLSTEAVNHSIFEFLHEAYQIRISESENLVRLAMLTAEQAAVMKQPVGRPVLALDQTNYYGKGVPFNYSTSYYVYPDLGFYSRSFPVTAG

SEQ ID NO: 8437 - protein, 106 aa, Lactobacillus casei
MAKKKILLVCNAGMSTSLLVTKMQKAAEKDNIDVDIAATASADISNKINGENPNVMMLGPQVRYMQKDLAAKYDFPVEVINMQDYGMMNGENVLKAALKIIDQEDK

SEQ ID NO: 8438 - protein, 119 aa, Lactobacillus casei
MSEKAKTNTNENEDNLETVMGLIVNGGNAKSSAFEAISAAKEGNFQKADSKLKEADDFLAKAHNSQSGMLTNEAQGKHVPVTLLMVHSQDHLMNAITFRDLAGEIVALYKRLADSNVTE

SEQ ID NO: 8439 - protein, 492 aa, Lactobacillus casei
MTKNTAMPPNFLWGGAMAAHQVEGNWQAGGKGVSIADVMTAASRTQPVRQVTEHIDPQKNYPNHWGIDFYKTYPKDIDLFADLGLKVLRTSIAWTRIFPNGDETTPNEEGLKYYDDLFDALLSKGIQPVITLSHFEMPYHLVKAYGGWRNRKLIEFFVRFATTVFKRYKDKGKYWLTFNEIDNQSDWRLPHHLLQDSGLQLSTDDNWEEAMFQAAHNEMVASAKVVKAAHEINPDFQVGAMLAMVPIYPLTAKPSDQLFALRAMQYRYYFGDVQLTGSYPAWLLNYFKSKQYNIEITESDRKDLQEGTANFLGMSYYFSFATEARQDGKVAFDEHNDLVSNPYLSKSEWGWQIDPIGLRYILNWANDRWHKPIMIVENGIGAYDKLTPDGKVHDDYRIKYLHDHIEQMKLATIVDGVNVIGYTMWSPIDLVSASTGEMAKRYGLIYVDRDDNGQGSDRRFKKDSFYWYQHVIATNGSDLEPVRNESHSKQPE

SEQ ID NO: 8440 - protein, 92 aa, Lactobacillus casei
MATAKQTTMTIRLDATTRDAAEQVFEALGMDLNTGINIFLKQVVHDQALPFTPTMEDSLDQATEQSIQDLKVGRYQDFDNLRDLFKDLHDEN

SEQ ID NO: 8441 - protein, 96 aa, Lactobacillus casei
MKDLLIRHQLEESHPIREYKAQMILKALTATATVSEPNAKLEALRQANQRTNAVIERVVDEVKKDRTVFCREQCGLYQLREQKVNRILDDLTTESK

SEQ ID NO: 8442 - protein, 559 aa, Lactobacillus casei
MDLVEELVNVVGKKNVITNKAKSLRFRKGYRSGKGDAVAVVFPTTLMAMWRVLNVLHVNNIIIIMQAANTSLTEGSVPAPGYDRSAVVVNGMKIKDLQLINNGEQVLAFPGTTLFHLENELRPLKREPHSVIGSSNLGASVIGGINNNSGGALIRRGPAYTELSLYVWIDEHDEMHLVNHLGIDLGKTPEEIITNLQNRNFDLNQVPATEHHASMFHHEQVVRDVESDKPIRYNANPKELYEVSGSSGHVAALAVRLDTFPMDKKTQMFYIGTNNPDELEDIRRHIMTTFKELPVSGEYMHKNAYKLAKKYGKDSLIVIEKIGTGHLPQMFALKAWGERFLKHIPFFKPYFPDRLLQTLSNLFPNQMPKRLDDYYEKYDHYLQLKMAGNGIEEAREYLKSYFDKASGDYFEADANETSKAATHRYVTAGVAIRYQELKQDSIDILPLDIALASNDYKWFEHLPKEIEDKIEHKIYYGHLLDHVMHQDYILKPGVDAHELKKEMLKILDERHAVYPAEHNVGHLYLAAPALIKHYKKNDPTNSFNPGVGKQTMSKYWGEY

SEQ ID NO: 8443 - protein, 102 aa, Lactobacillus casei; identical to SEQ ID NO: 2602

SEQ ID NO: 8444 - protein, 112 aa, Lactobacillus casei
MTRANVSDRDGASAMIALHAMHLRQVQNVLVDGGYSGVNFQLDVASNLNATVQVAKRNELHRFEVMPQRWVVERSFNWLENCRRLWKNCERQLTTSLQMVVLAFLALLLKRF

SEQ ID NO: 8445 - protein, 632 aa, Lactobacillus casei
MKFQRYINQHTNQITLITAILIGVGLLGKVVDSDMVYTVSFIAASIISAVPIVLRAVSALRFKTISIELLVSIAVIGAFIIGEYNESAIVTFLFLFGTFLEDKTLAKTRHSIKNLTEMAPTTAMVVDDDGNTEETDVDFVDVDDVVLVKAGGQIPVDGEIVDGFGHINEASITGESKLVTKGTGDQVFSGTILDNGTLKVRATKVGDDTTFGKIVELVEDAQDTKSPAEKFIDKFATYYTPAVLIIALIVGLITKDFRLAITVLVLGCPGALVIGAPVSNVAGIGNGAKNGVLIKGGEVMNTFANVDTLVFDKTGTLTEGKTAVTQFKDYSRDQLALQIATAVEKQSDHPLAQAVVKFSGDHHIPFEDVQVADADTVKGRGVKATANGKNVLIGNLRMMNDENVDLTSEQRQDLENIQGEGSSTVIVAFDGQIQAILGISDVIRQGVKQSLATLKSLGIKKTVMLTGDNLQTANAVAEQIGIDEVHAELLPEQKVEYVKQFQQEGHKVAFVGDGINDSPSLVTADIGIAMGSGTDVAVETSDVVLMSSGFNELIHAYGLSKKTVINTKENIFIAIATVVALLIGLILGFIYMASGMFVHEASILVVIFNAMRLINYQPKAAKLDPDQLSVGE

SEQ ID NO: 8446 - protein, 73 aa, Lactobacillus casei; identical to SEQ ID NO: 3941

SEQ ID NO: 8447 - protein, 182 aa, Lactobacillus casei
MTTATPEKLFEAEVKQADIDHHTPTAGAMTGHIVANLEVLSNKLQMAKWYVKGMSAQQLKVLFGDLLKQAYDQKDALGTVLIDEALITPSTQKEFTEYTMLEENGQNKYESVEWLVNDFVHDYDTENMFVTRAIKLAEKEDRPVLAQHLVGLLQDNNHNIATLQALLGKTPREGLDEEDDED

SEQ ID NO: 8448 - protein, 103 aa, Lactobacillus casei
MRTRRIMLTSAIIICVLLIFVSINVALIGLTLVLSWTSYQLLIKKDYTLLQTSIFQNVSLRMPDFDKLSQEQISTYQRTAYRVGWWILASTIACVIVLICLNL

SEQ ID NO: 8449 - protein, 49 aa, Lactobacillus casei
MNLNVGIDVSKLKLDYCGMDSNKQVCFQGEVTNTPKGAGHIRDEILDSF

SEQ ID NO: 8450 - protein, 401 aa, Lactobacillus casei
MLTSTNVPEDKRSPFLALGILSISFLISVSNAVSGTIPLMEKYFSDVSRANVELLVVIPTAGVLLGTVISGLVSNLLGKKYTVIAGLTISLIFGIIPAFFFSYPAILISRAMFGVGMGVFTPLSVSYITDLFPEETRNRLLGWRNSVGSIGDAIMLFIAGFLINISWHTTYLVFLFLLVPIILVMMLVPKQYDNIVVEEGGEVVEEVAKAKPTTNGGVIQLAIIFLFVCLFYSAIGLKLASYMVNNHVGTAADATRIFGFLVLCSIVSGVAFEKIAKWFGKYTVAIAELIVATTMIVMAFTESIPLLLVLVLVSGFCNGIVHPALTARMVHYSPKDSMNFTTSIIIIGINIGGLVAPYFFQFFGGMVGNAGPGNMILWSGFFFVLLAAYDLIIVKKDELTI

SEQ ID NO: 8451 - protein, 353 aa, Lactobacillus casei
VNDQVKWFKDAKYGMMIHWGLYSLLAGEYRGESSSVYAEWIQSKFQIPNAEYEQLATAFNPIYFDADKIVSLAKKCGMQYLVVTTKHHDGFAMYHSQVDAYNVYDATPFHRDVIGELAEACRNAGLKFGLYYSQDLDWHEPDGGGYKSNHVETAGTTWDNSWDFPDEKQKNFDRCFDRKILPQIKEIMTNYGDIATAWFDVPMTLSEAQSQMIYDTVRDLQPNCLINSRLGNGKYDYVSLGDNEIPKHKEDMTKTDVDFNDLSGFKPSPLGLYETAGTINDSWGFSYHDQNWKTPRTLFRYKQHLNDFGINYLLNIGLDPLGRVPMMAEENLLAAKALEDVADVQEARVASVV

SEQ ID NO: 8452 - protein, 407 aa, Lactobacillus casei
MTNPHLSFLRIDILDHPLFAQKTSFSLTASQRVPNDAHDDMTHLFGSIWINNLTTLIGRNASGKTLTMKLVMGILDLLLHQKSIGQTHLNETLMGSQPISFSVYFYGSDHFLYRDDLTIAPVPDQAKQWQVKDERIWAKKVQKSMTRKSIFDFSNAELLMDRLQLDTFQQSLLAADDSFMRSLIAQHHYQTQKVFDTFMFTNANLPFFPSSNGQVPDAILAYLDPTIDYLFIETNKHGKAFYRLKFKQDDQEITDNNFATIEYYLSSGTVKGITLYRYVVQALQSGGLIFVDELENHFNLAIVHTFMEYFANPKINQHHATLVFSTHNADLLNDLSRGDQIFITRRRQGKITLGRYSKIADRQDINRAEVFMSDYLGGTAPDYATYLKLRSQTIDLNQQPASGKLLQ

SEQ ID NO: 8453 - protein, 166 aa, Lactobacillus casei
MSTPTHEEVIRPMTAADDAPVAALIRECLKAADLDRPGTVYFDAGLDHLSQFYGAAPNRNYFVATQDGRVLGGVGIAEYDPTHGVAELQKFYVHGDLQGHGIGKRLLRHALDYAQQVGYQSVYLETYHTLKTAVHVYQEFGFASLPGPLVTAQHQLMDQFLLKKLA

SEQ ID NO: 8454 - protein, 112 aa, Lactobacillus casei
MNNPSTLKLIQKWLTDNQKTQAWLAGQLNMSAALLSQVMNGNRKLQTKYIIAISDITQIPLEQLVGTKANDNHQPQIALRGRLSTDTAKKQIDQLLLDIQHCVDLEETIHAK

SEQ ID NO: 8455 - protein, 270 aa, Lactobacillus casei
MQSNSLTSTFLSESVAEDLAETFLINYFGSDFFISADIERVLAEQVNIVYQDVDDSNYSGAAISYKGVHFIALNTHQTLRNRYYSAAHELWHLVVGSDLFSIDHTKYQKLISLPEFNTERAADHFAAAIMMPRDVMIRTWNRYIQNQTSPNIDMVTDAIIRIANVSAMPYAAVTRRLSELDLLANKKVARLTDKEWQDLVTKSTFPPSPLDKIEPFKKFSRLTNIVDQLVQQKQLSLLEAAQLTTYADPHTAAQYLNKRQELVNHLEAGE

SEQ ID NO: 8456 - protein, 193 aa, Lactobacillus casei
MLLFAAQYNKENIFSWFNKLYGNIWIHIDVLDEMLLKRQRVEAEIQAGRWRLFDPLTNFSSAERFIYNAQVEETKEAFARLNSNRAASGKRVKSTANTGEISTLAMCLIEDAHLICSNDFDIRDVVYSENYTYIDDDGEHLIVQDTAEDFCFLCVAESDITKAQVRHFYKTLFECPDIRNAKLASLDKRLVLL

SEQ ID NO: 8457 - protein, 390 aa, Lactobacillus casei
MIKLIDFEISGHALFEDGTKFSIQATGQNNEATAKRVIDYGYALYLNRTIGVVGLNASGKTTLFNLFDGLNAFYLEDQSIDQTVLQDSLRGKGDIKVVANIANTHGVRYQVQTIFRQDKDGKWVVANEEIYRKQLGTLARKKDQFNFKPSQLVQRRSDLRVEVKKMLSSKDSSFRAYKGDESVSRVFSIVDEVDASRIITFIDMAPTSLIQYLDESIEYLDCRTDKETHKLIDVRLKFKGQKDSYVASTFQDIMHYLSSGTIRGITLFYQMFKALRAGATLLIDEVELHINKRIIEDFIAFFQNSRINIAEASLVYSTQYLELIDDSVRKDENYILAKKQRTRVYRYSDLDIRGDLKKSEVFKSNYIGGTAPIDEHLAALKKELTKKISV

SEQ ID NO: 8458 - protein, 457 aa, Lactobacillus casei
MKKLKVRLDAFSDAVIAIILTIMVLDLTPVMKDNWANYLVLCKELGVYLISYAFVANMWYQHSTLFNEIDDMSYRIMLYDFLFLILLSLTPLATNMMASNTTQVTVMAYGVLLAVVSFSFRLLARAIIHFQYTAASDMRQVYGKIFGDHNRIYTLFNFILIGLAYFFPHFVMWFYLPYPLVYLLLSSRDRQQMYDVAQLTPSQRADYLKLPREKMAAFRKMIADQAAPETGNTTTRPANNGSRPVLPWLDRVVGNGVETAAPRTPGGRIDVEQLRALRREQWATFLMQQKAQHAKGKDNHHAEHHEQEDADKAAAQQLELKKKAQKQADKEQERQQERQADAAKQAAKERERQQEIDEDTQEAARHDLARRQKLAQEAKEHEQKMAAKAAEQALDLQKHQLRMDRRVQKARLKAQREEVKAQARRAKIARKAGIPVEESGQEASTSKKRGESVHKQD

SEQ ID NO: 8459 - protein, 453 aa, Lactobacillus casei
MGVAPLTTKGKWLQGGLFAVANLISLLPLLVFATLYHGQSPTAYLPYIFFYTGTKTGLLLVNGLGDVQNAYRLARNCLWLCTAALILLSVFSQAVIQDTAAFVLGCGASAFLPAYQAVYYHERRVWHWNFAAIEMLGFVLYGIVTLGLILWSGQLTMRVGFWVLLAFVVGGLLFLIRLPQFAKSPQTPTFVAKTSSRTDLELFFWLTAIVFCLRFTRFFANSLGIVLMVVFTLGFFLFILRIALHHQIRIDFPWWLIQSSFINGVYETFAMLYILFAIHNQKLMVGAYIAYGLGLILAQIVRQAIQNKFRHIANLQLQLIGFMLGGWLMIIPSISAAGFFLIGFIGSANSILLNHQVYRFNISTPANRLAVKYRNAYLGSILLQAMLVFGGLIAALLSHTDLTRLFDQANAHSSIVISDSLVQLVSLGIVVILTIVTFVLGRRLPRINERKLL

SEQ ID NO: 8460 - protein, 367 aa, Lactobacillus casei
MYTNERVKRFQLFKQQLAVTEVKPFSQPALFTLLGKIGYIQLDSINVTNARSQDIFLWSRFTNYRNTSYVDAYTKGDVVEIYLNALSLMTKDSQLVRNLHRMNLAKLQNDVNYPDYIKIYRQLIQVGRVYKKDFVTNHNLPQWEMSKEDNAIDKLWRAGLIDIQRDRSFRKILIAAKDDFDDSPADVNELEKQVYADLLLLTFNNLGVATKTDVFNGAHFRKRLFDSVFDELLKEKQITNITVEGQDHYILVSDLDAFHHNDILPNIAILLTPFDNLIRDRARTLRLFGINYKLESYTPAVDRKLGYFALPILIYGDIVGTVDLRFDRARKQLSVNRLVWKNEKVNNRANSAILDDVLQRFGRFISH

SEQ ID NO: 8461 - protein, 107 aa, Lactobacillus casei
MQTKTRKQGNSLILTVPKEFNIVPGQKVMPELKANGIFYRFVDGGDDFLDFSTDILKFLVAQGLTGSELVSEFDRQKRAISESLGSLADDDDTLALSRKKLEKRIGL

SEQ ID NO: 8462 - protein, 209 aa, Lactobacillus casei
MATKDLNLLIAQLQAIAQSGCYYTKDVFDRERYDQLAAITKQLVMLLGDATPEQARLFVDQDIGYVTPKVDVRAVTFIDDRLLMVQERAGETWSIPGGWADLGYSASEIAVKETREEAGLTVKPTQLLAVYSVRKRDYAPQSTRDVYKFFIACEPVTNALKTGIETENVKTFSREEALALPLSLQRNLPADIAMAFAAHVAEYWETQFD

SEQ ID NO: 8463 - protein, 68 aa, Lactobacillus casei
MVLGLSNHIPTKGGASLSSVIDAFAAITAGLGSAIVMVNVFTRLIKALKKLCHAVYELKQALGKFREK

SEQ ID NO: 8464 - protein, 70 aa, Lactobacillus casei
LKRKVLWLVNGILAIAIVGLTITVLVRQVDGTGHVETLQSRLASLAVIGVVILVIALVEGIYLFISNRHS

SEQ ID NO: 8465 - protein, 190 aa, Lactobacillus casei
MAALSLGEHLKQLRMERKLTQAQVAEQLFVSRKTVSTWETGRHQPDLQTICQLATWYQITVDELIGQPSEPPKTQKHTMTFLWSAFAIMVVGRLSLAALPGMLIFTDFVLVILACLLVGRWRDWLNFYYLKGFCGMLALGLVGVAWVNIFDMAFSLQVVYMATAVTLLFPVVRKALSSAGHLLVTKFKRR

SEQ ID NO: 8466 - protein, 1787 aa, Lactobacillus casei
MHQGLKKRQCRVPRSLLYSSAVLSLTATAIYYTSTIPVSAVKADPGTSKATAKAATSNLQIVSVTKQAHYFEITYSNNLKARLFILADNQFRFYADPSGKFDAPAQSGDGLNAKIFTKTVDTSATKPFDAAQLANAAKGWQVQTKAITIAFDKAAATLQVLQGNKVVLAEQQPLEMTADHTTQVLKRSGQDHFFGGGTQNGNFTLTGKKIKIQNTNNWVDGGVASPNPFYWSTAGYGVVRNTFTPGTYDFDAAGDGQVKTTHQEERFDAVYFFDAKPADLLKDYYDLTGAPAMMPRYGFYEAHLNAYNRDTWVPVSADTPGAIKFEDGKYYKEYQPGKVPAGQSGIKESLNGELNNYQFSARAVIDRYAKNDMPLGWLLPNDGYGAGYGQTDSLAGNLANLKEFADYADKHGVATGLWTQQNLSPVDPAHPKPDDRDFAKEVANGVKALKTDVAWVGSGYSFGLDGLEKANQMLTKVKGDDLRPFAITLDGWAGTQRYAGIWTGDQTGGQWEYIRFHIPTYIGTSLSGQPYVGSDMDGIFGGGNPIVNARDFQWKAFTPIQLNMDGWGSNPKTPFSFDDQTTAINRAYNKQKTMLMPYNYTASAQSVFDGKPMVRGLFLDYPEIPEAYTDLVKYEYLWGDNFLVAPIYQNTAADDKGNDVRNGIYLPDKNQVWVDYYTGKEYRGGQVLNNFDAPIWKLPVFVKKGAVIPTTPAHNTPKAFDQTKRQFQIFPAAGKNDFTVYEDDGISQKYLKGAHAQTKITSELQKDQLEVTVDPLTGDYSGLDPERTSEFAIRTSGQPKKVTAMVGGKAVTLKAVDNLQDYEAGSNVYFVNKQYHTNTYLEKLADKQIDQNFLQVKLDKTNVKTNAIKLTVSGIDATDDPTTGDLPESDQVPVPTDVKQDDKTTTETAIGINWSPVKDAASYDVKADGVIYRNLNKPAFVLDQVKDNSKHTFQVRTVTTKAVSKWSIEQTFSSKENPMRLAVKMHNPKVTSPIKDAPVWQGDDTVDNLFDQDLDTMAHSNWFSDTPKQSPTPMTITTELDGVYDLDHVTYVPRENGGNGNLSALTVETSLDGIHWHQAGEGKGWKWDSTDKTINFSEKEKAKYVRFVIPEKSTVGDFVSGRELLLFKRDGTNKATLGDITNDGQVNDDDKTSLMNYAGLTANIDSDFNGYVQNGDLNRNGVIDAFDINYVMTKLGKQPVTKPDETTPAGTLALQTDKPTYVPGDTITLSLVGNHLDKVNSLFARLPLTNPNVDLVKVEPTKATANMVNFSKIRTHGDNSRDIYLIFANEGQQPRLYGDQKLATITLKTKTQMTKADLQFALRDLMLTNQWGPEALPQDPSPVTVQQSASEQAQAKTKLMALLDAVHALDPKLFTATSWQAVATASDSAAQLVKDDTASIEALTKAYTDLQKALQQLEADRGVTQAQLKGLINAAEALKPDAYTEDSFAKLLAAVAAAKPVNADEHATQVQIQSAIQAITAAWVALELKPQPTPVTDLTQWLQVAAALKADDYTPASYAKLTDAITAGKKVAADPNASTAAQQAAVDQLKAAIDALVPRANKQSLEAVIATADKLSASAYTASSYAKLQAALKTARPLLTDLNATQAAVAEQTNAVLTALQQLVKLPDKTELVKLITQAAGLKKDAYTEASFNDVQAALAQARTVQKDPEATEAQVAKAVADLKTAIDHLVKAAPEPDKKDPTTPPAPAPNPGKKDPATPTPKPTPGGGFQGGQPTQSGKTPESRKETNDTNTIPKTGEQTQSVLAVLGAALIGLLGYVKLRKHKHE

SEQ ID NO: 8467 - protein, 755 aa, Lactobacillus casei
MWKQAKLYVYSAAVLCMTTIALLCVPGTSVSNAASNSSTGSGSDHVATQLKTTQDNSVTNLIPNPTNDNSSNERNGVAFSTQFQTTYKNGTSVITPVSTNSNSITNFTDLSKVDEISTLKNSNSTAENINVIFETPDFKGVDPNNIEANVAAAPTFSQDMAKAGLKVLYSGKPGVYDSQSDFLSQYKWSQLIAVQVMGDLPANSKITMTMPLTLSNTTDKTIGAGDYNRSTLFVQTLAFGDKGWGSTTTTRFSEPYDMNFTGYFAAKRDSATQYTALPDSIQKLMPTTTPNADFTAYNFSNLLDQPDKTGTVYKGGLIKLDLTRIMNAIKDQGLSVDVGADGQFVKSYLYDTVSDTKVQIVDENGKPISIPKTDCYVEIHQVIDTKDTTIKEGSTWNPKDNLVSAVSPKDNSDISSQIKTDGKVDTSKPGTYAVKYSYTLGGVTISKTAHVTVAEPAPVKGGNVTVSYETTDGTKLASDVTLSGNVGETYTATQKQFEGYKFKSVTGQPTGKFTSDPQTVTFVYEKEGVLPSTGGSGSNSSSSNVPSSSSASSESSSSNVPSSSSASSESSSSNVPSSSSASSESSGSNVPSSSSASSESSSSNVPSSSSTSSESSSSNVPSSSSSASESSNSNVPSSSASSSSSSNEPSSKASSSESSSVAPSASGNGSSSASGAVTPGTGINDNNNGNGGNGGNGGNGPQLPNVTGNDNGGNNNHRLPQTSEAVNALVGIVGAMIVLTGIVGLAARHLAHQAK

SEQ ID NO: 8468 - protein, 481 aa, Lactobacillus casei
MNMNPAMLTDLYEFSMANGYCAALPHEDQAVFDLFFRTVPDHGSFVIAAGLQQVVEALHNFHFEDADISYLRSLKLYSETFLDYLKNMRLDCKVLALPEGTPVFPREPLLTVQGPLMQVQLLETLLLNIVNHQSLIATKARRITAAAEGRPVMEFGARRAQGPDASVYGARAAVIGGCSSTSNVLSAQQFNIPAAGTMAHSWVEAFPDELSAFRAWAKVYPDNSALLVDTYDVLKSGVPNAITVFKELKAAGHHPVGIRIDSGDITQLAKQARQMLDAAGFPDAKITASNALDETVVQSLLKEGAPIDNFGIGENLITSASSPVLSGVYKMAALQANGQWLPKIKVSASREKTTLPSHKQVYRLYHHNSKQAFADVIALADETLPETIAAVNANPLATHPQVTLSDFSARPLLKPAFNPGKELSVTTDVFAIQKYARQELAQLPEATQRLVNPDLYPVYLTPKLATLQQQLIDEHHQNSQK

SEQ ID NO: 8469 - protein, 186 aa, Lactobacillus casei
MAHSNEALLIIDYTNDFVADKGALTCGKAGQVLAPTIVALADEFLQQDGWVYLPTDVHTPHDPYHPESKLFPPHNVRGTWGREFYGPLAPWYAAHRDEERVNMFDKTRYSAFAGTPLDLRLRERKIDTVHLVGVCTDICVLHTAVDAYNLNYQMVVHKNGVAALTPAGQEWALDHFAHVLGATVTD

SEQ ID NO: 8470 - protein, 236 aa, Lactobacillus casei
MADEFVAHPLITITNVIWSFSRTTHQLQILLIHRADEPFAGYWALPETTLRVKESADAAAIRLIRDKIGIHVNRGSTEQLATFTDPARTPGERALALTYMTYLPTMPKLRPGYGATDARWFAFDAVAGDEQLQNGRLTFHMKPEAADLAFDHARILSVAIGRIRNKLDYQPTILQVLGPTFTLKEAREVYAPFLHTTAAAIDNSNFKKTHQRLFIEVGVAHDRSRSGRPPKLFKLA

SEQ ID NO: 8471 - protein, 164 aa, Lactobacillus casei
MNGYLLDSDIWIISNRHYRQRFFPIVWHFFLNTEHLYMLDRVYEEITTKDDELSVWVKEHFKGKTIVSDLFVTEYQVVTQYLMTSQKWTAAGYEQWTGDYQKADPWLIACALNKKMTIITNENMTGPNGLASKAEPKIPYVANQLGVATMNFWDFLANEKFIAE

SEQ ID NO: 8472 - protein, 368 aa, Lactobacillus casei
VADTRVQVNKRLIDWALATTDLPNDVLADIQQRNKWLQVDFKHYLQPTVKQLGLFARRLHVPFGNLLMDEPPKEEDIRLAFRTQENVPAQVSLTLRDIIYEMQRKQDWFKHESGVANQQLTFVGAARGASASETQRMMARFIVLHHAESPRHLYKDLRAQLSQLGVLNMQKGGAGFGTNRPLNVSEARAFVLLDDYAPLIFINQKDSYTARIFSLIHEFGHILHGTDELLKNLDSEKQEEQLINKATAAFLMPEQDFIRRVKEYDIRKAAQFFNVSPLAGAIRAQGLGLIDHVVPEDFTEQPVASMDSTGGNPYNNALSLNDNRYMNTLVAAQERGAVQPTEAASLMGISYKMMDRTIEKFIEREVLT

SEQ ID NO: 8473 - protein, 232 aa, Lactobacillus casei
MTVAIYGHRGYPARFPENSLQGFEYACEHGIDGIETDVQMSADGHLVIMHDERVDRTTDGTGWIADLTRTQLKGMRLANGEHIPSLREALTVLSRYDVMVNIEFKTGKIRYPGIEALTQDYVEQFDMQDRVIYSSFNHDSINVVHTLAPKMKTAWLTSRVLMGATLPSYLEAVHIEHYNAHLDKAQRVWTVDDPLQMKQLMREKYVVGLITNRFEEAMDMRELVAKESKSPV

SEQ ID NO: 8474 - protein, 457 aa, Lactobacillus casei
VKTTYKKIIALIAALAVILGLAFFLTDQHKTAAASDNGRTTITFWHSMNGPNEKVLEKLVDQFNKSQTKYTVKPIYAGSYELSIMKYANTVGSNVSPDLIQSDQANQSMMIGLNSTVPVQKFIDRDHYDLSQLYPGVTAAYKINGKLASMPFNSSSSVMYYNKALFKKYGIADLPLSPTYSDITKAAVALTKKSKGAVKGMTMQIYGWLPEELVANQNSLVVNHDNGRQAMATQATLNSPEMVKSMNWLQDVIKQGAFQNFGTGSAAANNQSAAFLAQKVGIFMQSSAMLGQLQKNAKFDYGVTFTPHPDDTKANGVAIGGASLWITKNKPTAVQEGAWQFMKYLMTPKAQAAWQLGTGYFAVNQKANKVKTLATAIKKNPALAVPIEQLNQGKINAATAGAFFSNIQEERQNVELAMQQIYGGEDVKKALDEAESDTNTAISKTNSVSGNLLDYKR

SEQ ID NO: 8475 - protein, 271 aa, Lactobacillus casei
MTHVKNGTRYLLLTVVAVVLLFPILLGIWASLLPTKDIAAGNFLSTNISLNNYWQAFVTTPIIRYMINSFVTAGLITIGQLVLCTLAAYAFAFMNFRYKKQLFFAFLITMMLPFEAQIIPNFQTVKAFGWLNNYAGLTIPFFTSAFGVFMLRQAFLQIPTDLVDFGKYLGLGRLQFLWKIAIPYSRSMLITFSLYTFLTHWNQYLWPLITTFSDDFRPVQVGLKQLQAEDTFANWGMVMATAIIVLLPTLALLLIGQKFFKRNLNAGGTKG

SEQ ID NO: 8476 - protein, 310 aa, Lactobacillus casei
MELNKELNKTTTESKGKVVATLRENNKPAFWFLMPSLLILTLFTFYPMIMTVYNSFFATNIRGESAKFVGLGNYLDIFKDPLFLKSLAGTLVYVVAFALVTIILGVTLARLATMKLRRISWFQTAFAGTMGTSAAAASILWLFLFNPSVGLASFALKAMGVTNANLLVDPTGAMIVIVLASVWMALGFAFLILLSAFQSVPPEYYEVADIAGWSQFKQTLKITVPMISPTLFFLFVVEIIDGFKMFAQIDLITGGGPNNATNFLAYKIYQDAFAFHNFGTASAESIVLTVIIALATWVQFHFTERKVYYA

SEQ ID NO: 8477 - protein, 371 aa, Lactobacillus casei
MSIRLANVSKAFGNTKVLSNISVEIEPGEFFVMVGPSGSGKSTLLRMIAGLTSVTDGRIYFNERDVTDLPPKDRKLAMVFQNYALLPFMSVAQNVRFGLENQDLSDDEKTKRVDWALDLVHMTDLRDRKPKELSGGQQQRVSLARALATKAPVVLMDEPLSNLDAQLRTEMREEIARLHREIGMTLIYVTHDQVEAMTMGDRILVLDDEKIQQLGTPLDLYNHPANEFVAKFIGSPEMNLLPITVNDEGDRFSIGNAFWTDNAFVLPFDLPAGSYHLGIRPEKLVPVSIANPDTITVKVKSLQQLGNDTLIFCDYDGQPLVSRVPEQFTVAVGAELNLLLPASADEWHLFNVDDGERIVAAPVKEAAGYGA

SEQ ID NO: 8478 - protein, 261 aa, Lactobacillus casei
MKHAHLVEQLNQLHRHFAEPHALLLADNRRLLFGAKTDTLFPAASLIKLGIAAYVKKRAEADPFQWNRMVELPATVGGAGVLRFMTAPSWCVRDLVTLMLMVSDNLATNALLKLYGLPTISRWLAEHFPGTQLNRALMQSHADNDNRITAEAAWRLLHDLLTPTHQSADGDWCAQALRHQQNRTKLLLAPTMQAFVGWTAGKSGELSNCEHDAACFAAEGEQLYAVVLTTYNHRREDAMRFNQQVGQLIVDDFQHRRDRLL

SEQ ID NO: 8479 - protein, 339 aa, Lactobacillus casei
MANNPDLVAPITQAIHAGAVFGASFSLVAPDENALYFLGYQGAGDDQLPLMPQDRYDLASLTKVVGTTTRLLQLLVAGKIQLDQPIGSLVDGLRYPQLTIEQLMLHRSGLPADVANAHDLDRDGLINAVKTMPAVAPPDTTTIYSDLNYILLGWAVAQVDGSLAASLQKHIFVPLGMTATGYQPHGVAARNFVPTEKVPERGGVLRGTVHDHKAFLLDGVSGHAGLFATLGDLTTFTRLFAGLPVPNGEAVLPPAAFSLLERFCVGGRTLGWRCWSANRHQYWHTGFTGTSIAFDRDNRRGFVCLTNRIYPNRTNRAWVRIRLQLLARFFGVATSWPDE

SEQ ID NO: 8480 - protein, 291 aa, Lactobacillus casei
MHIDTMTTPEIVALINHEDAKIAPAIAKEEAHIAAAIDEASQRYNRGGRLIYAGAGTSGRLGVLDAAELVPTYGIPPERAVGLIAGGMSAMFKSVEGAEDSAELAEHDLKHLNLNANDTVIGITASGRTPYAIGALTYAQQTHALAVSVTCVADSELATHADIAIAPVVGPEVITGSTRMKAGTAQKMVLNMLSTGVMIRAGKVFGNLMIDVLPTNAKLVDRAERIIVETTGVTKAHAASLLKAAAHKVPVAIVMAKTGMDAATATQVLAAHDGVVSAVLTAWEAEHGQQS

SEQ ID NO: 8481 - protein, 310 aa, Lactobacillus casei
MTPLLTRVEARLAQLSPVNRALAHHVLADPEAFVAETTAQIAQASGVSAASVIRFVRLFDFDDLQSFKLALVRETKTADDPQPLDPLVQDDDDLPTMMRKLSQTAIAAVRDLPEALDQDAVQSAITTLRHARHIYLVGISASALVAQDLYLKLIRAGYLAIFDHDAHTALERMYYTTSADAVVAFSYSGITKEVVLAAQQARRNHTPVIAVTRHEPSPLRNVASCVIALPPTEPLLRIGAVTSMFTETYVANILFLGVVHGEIKRTEQNYRATSQLTGELKIRGEENGNRRPNNRTKKSGQHAHRHDDDT

SEQ ID NO: 8482 - protein, 161 aa, Lactobacillus casei
VTIVAARVDERMIHGQVAMVWTNTVGANRLMVVNDEVVHDDMAIQGLKIARPAGKKLAISSVAKAIENLQNGKFAADQVFVITRNVPDMAKLIDGGVPIKSFNVGNLSEKPGTKKIKPSVALSPDDIAIIRRLLKQGVTITAQMVPNESKTSIATFIDKAE

SEQ ID NO: 8483 - protein, 278 aa, Lactobacillus casei
MSDLKLNKITKKDLKHIFIQNVLGLQLGWNYEKMQGLGYAYSVMPALKRLYKDDPAKMKQALNMEMGFFNTTPQMSHLIVGADVALQDQLGMNDENEKAIAGLKTGLMGPFAGVGDTIFVAIYNAIIYSITAYMALSNQPIGLLIPVVGCLAILWVRWKLFQVGLAQGTRLATTFADSMAIFTEGASILGLTVVGAMIPAVINYKLDLTYKVGKVTMNVQTMLDKIMPALIPLAIALFSYWILGRKHMNSTRLIFVLILIGMVLGNLGAIFGWIGSLV

SEQ ID NO: 8484 - protein, 278 aa, Lactobacillus casei
MSISAFALIFLTIYVGLAQLDALSLKIGLFSPVFGGAATGLVMGDLKTGLIVGATLQLATLGVATYGGATVPDFLSGSIMGSAFAIMSGRGAAYGIGLAIPIGLLLTQMDILARMTNTIFQHHADRLALKGDYKGVERNNLYGIIPWTVSRMLPVFVGLFFGSAVVKAINAWIPGWLMVGLKTAGIILPAMGIAILMRYLPIKRYYPYFILGFVLMAYFTKSFSLLGTALVGFVFAAIHVMEANERKHNGGNGNGPSKPDNGGNDSGSSDDEEVEIDV

SEQ ID NO: 8485 - protein, 399 aa, Lactobacillus casei
MLGYVKLCILLAKMAGMYTYLIVPVSGEKTTVIMIETKLNGGILVKRLLKWIAIVVGAVVLVAGGYLIYLFTTYYRLPDNQALKVKNQQDAQFKLGQTYTAMTYNIGYGSYPPSYSFFMDGGKYSRAYSQQAVRKSINGVIKTTQAQNPDIAFYQEIDPDGDRSRHVNEVNMVTQAQKQYANVYGQNYDSAYLFYPFTQPIGKAKSGILTLSKAKIDSSRRYSLPVDTDFNKIIDLDRAFTATKTTVANGKQFIMVNIHMSAFTPNVKVQQAQFAKLFKYIDHAYKQGNYVMVAGDYNHRLLKNTAEIFHTKNLEETWTHLFPKSKLPAGFHIPTMGLAEAKVPSARALDRPYQPGKSFVTLIDGYILSPNIKAESVHVVSTGFQYSDHNPVVLKFQLQ

SEQ ID NO: 8486 - protein, 310 aa, Lactobacillus casei
MSAEIERILAAFDQFDTIIIHRHINPDPDAIGSQTGLALLLRAAYPQKTVYTAGPAAPDLAWIGPQQDVPAAAYKDALVVVIDTANRSRIAGTHFDQGAMLIKIDHHLNEDQLGAISWVDTNASSASEMVWELVQHSKRLTLNQPAAAALYAGMIGDTGRFLYDLTTARTHLAAADLLATGIDAPAIGRREDQFPEKVGRLIGWALEHVKITANGAGSLLITQKVLQQFGLAYGEEQRAVGNIGKLASIDRWVVFTERQDGKYRVELRGKTKEINTLAVRHGGGGHPLASGAVADDLAEVQAITQELAQQ

SEQ ID NO: 8487 - protein, 50 aa, Lactobacillus casei
MTFMGDEKTLKVLVNKKNKAFLIELMKQPVVEANVLKMFQLVFEANPLDK

SEQ ID NO: 8488 - protein, 251 aa, Lactobacillus casei
MNQNEESWLEESRQAMHGWDFSHLKNRCETGALPWNYRDLVRQYLKPDDEWLDMDTGGGELMSSFEHPVEKTSVTEGWQPNIDLLKRALVPQGITLYADPKGQMAQVPSDHFEVVTNSHGGLPIAAIARVLRPGGIFISQQVGATNNYSLSRFLNEKYAPAFPDNNLLQVITQLQNSGFQILKADASFVKMRFTDVGAIVYYATVIPWEFPNFDVNRAMPKLHQLQDIIASVGDITTFEDRFIIVAKKDED

SEQ ID NO: 8489 - protein, 106 aa, Lactobacillus casei
MQWFYLVLAGGFEVVWATFMKLSHGFSRLGFTLATLAGMILSFGFLALAVKHLPLSLAYPVWTGIGAVGSIIVGVVLFKDQLQPATWLFIALLVIGIVGIKVTSGD

SEQ ID NO: 8490 - protein, 269 aa, Lactobacillus casei
MTLLNTLRIIETFLDWLSAINALHLREFDIWQVMNSVKTGLTDRADAFLGIDEPNVSDDERDADAAFIEEDDIGDQPPDEAYQPDESYLNQEHVDKIGDQQWQLATATSVHDQLLKYIRLAWAAEDSQDLRDAYPQSVVIDAVVQMGDALYAQHLETLQTWGPEHFLDYITNTIHTQSLEKSQALVASWMHLLLYLIFNDKIEKEHGDELLAMFARGAQFYPSQNQKAELSRYLTINGASEKVKSVVKSVNQQLPKLTHIFYLSNLTSP

SEQ ID NO: 8491 - protein, 68 aa, Lactobacillus casei
MSDQPISPQVVAKFKQYWPRFENSKLYRDSDSALGFDDNAPSVVQMYLSDMAEISGLKPAEWTIGDIR

SEQ ID NO: 8492 - protein, 242 aa, Lactobacillus casei
MSLINTQLGLDFQLSAAELEGSQNVFVAKSPQAMARFWARDEGDIVIRGNRLLVRVTNPEALIALRRAFGEEDGAWFLSMANLTKLATILSSFGLRVSNIAPFFVPSQRFVSNLMPEIHLIEADEIPAYRANKAITMAFGYDRHYPDRLGVAYQVDGELKAIAGASQNGDACWEISVEILDPQYRHRGIAVQLVKQLTATIQSRRPDILPVYGTQFSHVQSMNVAIRAGFVLGWTELMIGKC

SEQ ID NO: 8493 - protein, 164 aa, Lactobacillus casei
MANIRIVKATLKTDFAAVSRVYYDTWQSAYRHLIPAGFLKQLTPASWHPEKRWQNTFLAITGSEEIVGVCSFGRARMADYAGWGELYSLYVLPQFQRQHVGSQLIEQALKQLNQTYANNYVRVLNNNLAAQKFYLEFGFKKTDTVLEDVTRFGTIRELMMIREG

SEQ ID NO: 8494 - protein, 256 aa, Lactobacillus casei
LAQGDVDLEKITNFRELGGYRNKNKQMVKKGLLYLSGQLFELDDAQKRYLTETVGIQHIIDMRSADERAQFPDTTLPGAAYTVLDILKDATTNDASLGHMITEQGDVRENMLATYEQLAMSDSAQAGYHAFIHDLLAAPEPTVFHCFAGKDRTGVGAAIILKLLAVPGETIMADYLLTNQERKTANQVILADLKKQGVPASQLQTIALALRVDAAYLEHYFQVIDTKFGSFDQYLRQGLQLTANDIEKFQELYLQG

SEQ ID NO: 8495 - protein, 223 aa, Lactobacillus casei
MNEKRELQVKAAIAGALDAEDCIISFYCARKSQSIYVILGRPMSQYLAIRISNHRAFSGFQKVPTFFLRSQAQLTEELTEFLKTATWLTFDYQDFFVLSLIKYGHHHGTTFQIDDSYATFSEESQAMIFYQLIHLGRRQQVMMNALPEDLNYALAKLYASDLIGSFSNQQSLLVYLSEGGRRLLDLHAGQYIAQFMEDYEQVNWRNLNLPAVGSSTEQQQDQA

SEQ ID NO: 8496 - protein, 75 aa, Lactobacillus casei
VADTTVTFLQFKDDQYKKIKELADSHGVSVTRYMREAILERVEDEEDYNAATANLNASHGETVSRTEIRKRLELS

SEQ ID NO: 8497 - protein, 50 aa, Lactobacillus casei
MDFVRSKTESIEVLFVVSGQNKRGDSKNCSMQRLDHIQFLRMERLFWKKI

SEQ ID NO: 8498 - protein, 173 aa, Lactobacillus casei
LEKDLAPITLISAGQSNMDGRVPVAELPADIQLPLADCHYCSNYTPDHDKGVFQPSLKTSDLSQDRWGFDLVTYHNILQRTPYQGLYVIKCSEGGTSIDPTGDGDRHWTTHFDELASPDDSLLLAFTHLIKQCLAASQQHLDIKAKPTADPIRKLPPIITTTISRLSSPTAAS

SEQ ID NO: 8499 - protein, 163 aa, Lactobacillus casei
ASCHDMAINPRTEINMTPETYFTQVKQALGLPGSTQLQSAYQFGAEADKLAALVLAGKKTATASARDLYAVDEPLPQAGAYDVILNSSNEPVCVTYTDAVEVQPFLAVTADHAFREGEGDRSLAYWRQVHEAFFKAEYAEEGKQFDPAKARIVLESFHVVYPV

SEQ ID NO: 8500 - protein, 166 aa, Lactobacillus casei
MTGAANSVNIKIIGVGKLKEKYFREGIAEYLKRMDKFAKVKIVEVADEKAPENLSEAEMAEVKDKEGKRILAKIKDKEWVIALAIEGKQRPSEVFAKEIADLGTYGHSDITFVIGGSLGLSPAVMKRANDTLSFGKLTMPHQLMRLVLMEQIYRAFMINIGSPYHK

SEQ ID NO: 8501 - protein, 366 aa, Lactobacillus casei
MIVIRRLIRDRVLQITGLLVVISLFIGRPKISDISFATLWSILAMMTVIQIFEHLHILDYWAYRLTSRANNTRQLTWWFIFLAIFASMFLSNDVTVLTLIPLYLRVAKKYQLPEILPVTLIGMAANFGSAFTPFGNTHNIFLMHQFQINLKEFFSWSIPLLACSFLVLVLLSLFLRNVPVPNVPTEHIHIQIRPTIFAVIVACVVFAGVIGIVPAWVGAVLAILLSVALDPKDMKDVDYAVVLTFAGFFVIVSVVGQIPWVTHFIASLENSEDSVYLSGVLTSQVISNVPSTVLLARFTGYVEALFYGSNIGGVGTLVGSMANLLVFKQYLVYGSRPHARFFVGFTVFNLVALIILGCAGYWLTVR

SEQ ID NO: 8502 - protein, 327 aa, Lactobacillus casei
LKLTITDVAQKAGVSKATISRYLNGRFEHMSDATKAHIAAVIAELNYTPSRQASSLKTHRSHLIGVVVADISNIYSTLLISGINKVTQHSMDQILINDAANDLKREEKALKMLLSMNVDGIIMQPLSAVAHHYDLIRDSQTPMVLVDRLTRPLAWPTVTADDYRSTTKLAQAILKSHYRDILILINPVAQISTRQSRYQAFLDTFKNTTTTVTLLETENDSVAPLATWLEAHPQTHPLVFAANGRLLMATLRWMHAKGLRIPQDIAISGYDDWDWAELVTPGISAISQHPDVIGTTAAQLLAQQIAGEPVAVQRLEIPADVRIRSSF

SEQ ID NO: 8503 - protein, 253 aa, Lactobacillus casei
MPAPIVANLLLLASEWQAGKSQADLVSELVNLGFSTIEVRREYFRDIAKELPQVAELAKDHQLTLFYSVPDEVFVAEGQVNPKLQGYLDEAKAMGVTKIKWNIGAFAEFSGDLASALLSLTQQGIEINIENDQTTTSGRLQPVLTFLQAVTAANIPIGYVYDLGNWPFVGEDPLKAATALRQYTRYIHVKDDLTGGEKPVTVPLDQGDLPWRDILAILPDTVPIALEYPTAHHGIILEGKKLLQDEQARGSRT

SEQ ID NO: 8504 - protein, 83 aa, Lactobacillus casei
MNNQRLQIDPEQFALNFIKSLNIQVSPEKVDIEAASKEALAAYLSAFYLAERFNSTENKFFEDPDQSGIRSSYQRILSELNKY

SEQ ID NO: 8505 - protein, 425 aa, Lactobacillus casei
MGSLITGILLVLTFVLFITFAMRGGNLTVGFFVMAIVWTIIGLVPINVAIKEIFTDPVLNYGKTALYIILGSWFGRVLVDTGIAGSISRRTQSVGSKAPVIATILIAIITALIFSSAYGVGSAIAVGVILFPIMFSMGVPKNIAVSIFTLSIGAAMYINPVLFNQFTVFFKGVVWGDHYLRFGFVAMAIQMLVVIAMILFYARKIRNGKPFVVESETPETSVPPDVNPITYLLPVLPVAMSIFFKWDAIPALLLATLLAFAMTGNMKSYVHFVQMMNTTTKTAIGDIAGLLIMLLVLTMFQSAAVHTMGQFTAVFKRIIPDSRLLMVFIMIVIAPLSYFRGPLMLYGAGAATAAIFTATGLFPPYFLYGLLVVPTMMAVSADITQSWNLWSVEYAKLDTKTFLLTGLPWAWIATILNLLAAYVLL

SEQ ID NO: 8506 - protein, 324 aa, Lactobacillus casei
MSEFLTIGEPIALFASQDTDQSLKDALNFRKYLAGAEVNVAVGVSRLGHSAQYITRLGEDPFGDFIKDQLRENHVQTDYIDSTSDYWTAFQLKNKVSTGDPDIFYFRRGSAAAHFDAKTLDRIDFSEVKFAHLSGIFPAISEQALAAFRHLIDLLHEHNIRTTFDPNLRPQLWSSPQEMAATLNELAKEAEIILPGDNEGELLVGSRDPETIADFYLNQSERTQTVVVKVGPKGAYVKNKGEAGYWVKGFKVAQVVDTVGAGDGFALGLITALMEGKSQRDAVVRANAIGAFAVQAPGDNDGYPTPEQLQAFLDKNLAVMGDDF

SEQ ID NO: 8507 - protein, 208 aa, Lactobacillus casei
MKLQVAIDRVPLADAVALAQQLDGKVAIIEMGTSLVKDEGLAGFRAMRAAIRTSQLLIDLKTIDEGGYEFKQGFAAGADILTVMGAASLATLKTTAAATDAAKKEMMIDLMEVNATKQQAISIFPNAIYALHHSTDRQDHLDPTATVADFHAAFPQLKRLAIAGGIDLAGATALAAQGLTEIAIVGSAITKAADPVATAQQFMEAINA

SEQ ID NO: 8508 - protein, 180 aa, Lactobacillus casei
MKVIPDIMTEINQVMALVDEDQLDATMPYLTKDKRIFVIGAGRSGFQAKGFAMRLMHIGYTDYVMGETITPSIQKGDTWVAVSGSGTTKSIVADTEAAKKLGLNIVAFTSAVDSPLAKLADAVVIVPGATKTGAGVKSIQLLSTLFDQTVHITLDALTLKLAKRDDTSNADALHEHVNVE

SEQ ID NO: 8509 - protein, 279 aa, Lactobacillus casei
MKRRTLFSIIVVTLVAGCFTLFYGVHSTWTDTQSAHAVQAATNQVDTLFKDSSHQLPAAELSQEKIAAAEASLQAARRKLTEPEQANQLASAQADVDAAKQMLTVKNAVAQKPTKLTELKTLTSESQQALAKLAKQKPTFVQTYQKQVAQLSDQEAAVAKVASLFTDADFKEPKSGLSTSEIQAALAALKHIDNQQLTDQMLPAIATAQQAASDDTSSAEASVSSSTVPSSSASGSESSATNSQSTSSASSTSNESNQSQQESSNSSSASSASSSSSQD

SEQ ID NO: 8510 - protein, 107 aa, Lactobacillus casei
MSFGNSIKQKREAMALSRYQLAKSVHTTVTQVAIWESGRKYPNIKQLIMISDELGLTLDELIKGDSSFQKKIMIDKNNHDADMIVRFSIILEIVLFVVGILLIFHYA

SEQ ID NO: 8511 - protein, 39 aa, Lactobacillus casei
MAKVIYLGLIAFFFDKNSIIQGFLPYDKLSTPYDEDNVK

SEQ ID NO: 8512 - protein, 442 aa, Lactobacillus casei
MTLPMQAFLTQYLRLRSVSLATDNEIDETAAFLKQQFTKFGATTSRILTTEAANPAVYAVFPGQSADAPTLLFYNHYDVQPAEPLDLWKSDPFQLKMTDTHLYARGINDDKGELAARLAAIQRLQAQGGLPCTIKFLVEGGEEQGSPHLEDLLKQYADLLAADFCLWESGGRNEQGKFQISLGVKGGVAFQLSVKTADFDLHSSLGAITENPAWRLVQALATLKNAKDEITIPHFLDAVKPLTTTQKQLIDSAVFDYAAFAKNYGITRPATVPADDIKEALYNRPSMTINGFSSGYEGPGIGKTILPHTALAKIDLRLVPNQTPAETVRLIKAALTAGGYDDVIVSDFLGEPPFRTDPDDPRVQEAVALAKATYGDDEVQIELNSPGSGPMKYFYDINHAPIISCGIGNANSAAHGPNENVAIADYLRFIDYLTQLVGKLAV

SEQ ID NO: 8513 - protein, 536 aa, Lactobacillus casei
MKKYNALGLTCITLTLLLAACGQSTKAATNQRALNVAVSTEASSLDPAHAVDATSGAILQQIMTPLYDHDKSGKIIPAMATKVVKPTNNGKTYTLTLRKDVKWSDGTPVTAKDFVYSLKRIVDPKTKTEFAYQYDAIANYQDIVDGKKSPDTLGVSAPSKYVLKIQLSQPTPYFSSQMTGYYPTNEAAVKRYGKKFGSSADKIVTNGAYKIKNFSTTSDSGDYVKDPNFYAAKTVKINHVHVNVLKDSSTVDNLFATGKLDDAPLSGNLIQKEAQNPALTKTPAANMNYLQLNTKNPQLNNVNLRRAISAALDRQALTSKVLQDGSQPAKAFVPKGLKTNPTTGKDFTEDAKTPLTYSPTKAKAYLKAALKELNTDSISFSILTSDVDTDKQVGEYIQSQLTKVLPQLKVTVSSLPKMTRIQRSLDGKFDAVLMSWNSTIQDPSDYLNTATADNISNFSKFSDEQFTALMKKVNTTTGQSSTARYQQELAANARVIDVAGYIPVFQSANSRLINTKVGGLHYSMLQPAEYRYAYFK

SEQ ID NO: 8514 - protein, 385 aa, Lactobacillus casei
MKQKHIFQILVGTLIAGYLTVFYGMRSTIDTSFAQHAVQAATQQTNQLYTSAKRTFPAKHLSRSAVTSTQEKLKQLANNVDDRKQKKTILKDKQDADAASYMLTIEETTKAQSSNLAQLAEDGSQANKAYKAIASTKPEFAADYQQSVSQLYRKSLAISQIQKLYKDQNLQHPKSDLSSSSVDLAVNAVENVENQDFAKNVLPLVQVARKSQESSDSNVAMGNTTSSGQSTQKQDATATSSEPASGVGKKDNTSSQAPTSSASQSNQTDQSSSAATSSSSSSKSDNQTQPSSDPTASSSLEPMTTVLSGGLYKTYDDAVAAIKVQGKSVDDMTVKSVTMSDGSYQWTWGPTGDSGSSSKTSASSSTSSSAPTTSSDNAQSSSQNN

SEQ ID NO: 8515 - protein, 690 aa, Lactobacillus casei
MPTIFNGVPWYDQHQQVVNAVGGCLIQESGKFYLFGEYRQAESTEFAGFSRYVSTDLENWTFTGLALPVQPSGLLGPHRVGDRVKVLRAQTGQYIMLMHTDDERTFDPVVAYAMADRLTDTFTFKGPLLFNNQSIRMWHIGSFTDDDGTSYLLTHEGDIYRLAADGTTAEAKIISNIAPGTEAPAMFRFHDHYFLLASQKTSWGHNDNVYFSADQLTGPWTAHGPFCPPGTLTYNSQTADVALIPTAKGIVPLYLGDRHTYPHLENSTHVWLPLSVHETTLSIPHYWPIWDWYQQREQPMTFTPLAWTGQTNDARLMLKFHGTGITITGQSGTHGGFAKMTLRDEAGHIKSQVYTDFYSLLHEDAPCYRSPTEPLGHYELTIEALGVHGDWYDKSRRRYGSNGNRVTITGYHIDHPTNKRPKAVITYHASKQPFTLNKIGFNWAQSAIARPEGSGDYQWLQSDIGEGELTIGDQQINLRPGQGILINLNTSYAYHPVTSLWQTSYLSFNGTILDDLIPGLKTASSLFFPVLGTEVLGFIHEHTRYQQAHRYEDDQDAAIVQDFLTKLKPYTARFKADPTKQALAEQTLSLLQEHFQEDLTNEHLAEMTNYSVQYMLQTFHDLYQTTPRRLLTIYRVIQAKQLLIEQPDLPLSQIARQSGFHSETYMIRAFKRQEHLTPGEFRTIAHQLRS

SEQ ID NO: 8516 - protein, 229 aa, Lactobacillus casei
MQDPLNKKMLYAFGTSIVEGHAAHESFVDDIARAHHMVYHKYAINGATMRVVPNEDPVINIVHQVTQAPKIVPDLIVFDGIANDAYASVTDDPKVLGSISTGFADELDTATYCGAFETVCRTLLTKYQGAHPLYITTHKTPARTLATQEKLHDVSLAICRKWSIPVVDLYTQSGFNAFIPAYQHDYSYDKLDADGHNLNAVGGTGTHPNADGYRLFYEPQITAALKAMC

SEQ ID NO: 8517 - protein, 537 aa, Lactobacillus casei
MENKKAVVHDGWDEFASKKIYHSRGKKIGIGRSLGFGVFSMFSISMQGLVGAWLLFFYTTFCGLSAGQGATIFLIGRVADAIASLVMGNISDNIYKYKIGRRFGRRHIFILAAAPSVLFAITLWVAGMSYWYYLITYVITTVLMSVLQIPWETLPNEMTKDYNQRTTMSTVRMVIAGLGNMLAQFVPAQLFRFYPKTSPTPYLIMQIMFSIVTFFLILVTYKTTWEHFVTKNEAKKLQAQALEDNGGKKSSFKSEIRNYFSTFKIKSFRTHMGIYLSSYFASILWSTTFVYYIVFVVGKTTSVSGMLQSLSIVSVPVTILAGYIVTKISPRALYLFGYSLILISVIDWAFIGLTKPAGVMVWLIVGTLLYEIGLYILYFVPWNVFPFIPDVDTLVTGKNRAGLFASVMVFINQISQGLASVVAGYLLDVAGFRQSTSGAVSQPASATNMILFIVSGGVGIMILIAMFFASRFHLSKKTFNVLAAELTRLQKGGSMKDVKPDTKRVCEQLTGVPYDSIEFWRRNDQQPATPNDPSTKA

SEQ ID NO: 8518 - protein, 681 aa, Lactobacillus casei
MANQTFVISRNTSVSTDNMADPVLKNAVNILQRDIQKVTTSQADTNQIDLVLQPKADQKVPDAFAMHYVDPQKVEITAATTRGLMYGALAVSREVLGIDDFWYFMDTPIKKQASVTWSDFSQQLPDFQTKYRGWFVNDELLIADWQDHDSKEYVWDRIYETLLRVGGNLIVPGTDKESRFHRAGARDMGLIIAHHHAEPLGAEMFARVYPNLEASYLKYPELFKKLWNDSILEQRGHEVVYGLGFRGQGDRPFWADDTTHKWTDEEKAKVINDTIKLQYDMVQELDPGAQCSVSIYGELTGLFNQGLLKLPQDVIEIWADNGYGKMVSRRQWDDDPRSPVLTIPNKAHRARGIYYHVTFHDLQASSFLTLLPNSPHFVAAELEKVRKADMDTLELINVGNVKPHILFIREVARSWRRDFQVRSEDEIIKDYVNHYYSEAQKEITDIYEDYFKSPIQYGPHDDQKAGDEFAPYLIRKVVKAWMGHYPQLEQMNWLTGDVSLDEQLTKITQLIDTKYAAWDHLYRRASQVYADIMGQQPQRLFYNDMLMGIAVHACSLHALRASIEAYRHYQNAEIVHAFLGADEAVRANDAIMRLRRDNPSPKWVDFFHNDAYSNIELNAIKLRRLRSYLRVLGDGPDEDQWERKYLMEPADARVMLLSNTHLALSDDQIAKKLREQLIDEK

SEQ ID NO: 8519 - protein, 608 aa, Lactobacillus casei
MKKNWQLMMVLAVSAVALVFAFVLKQPLIAQGLITVMGSIIALIMFGGMVKTIRSGNFGVDLLAITAVVATLAVGQYWASMIVLLMLTGGDALEDFAATKASSELKQLLENAPTTAHRMVDGHVEDVDVDAVQVGETILVKPREVVPVDGTVLAGESLVDEASLTGESKPVAKNAGTDIMSGTINGDAALTVKVTQRAEDSQYQGIIKLVKESEARPAHFVRMADRYAVPFTLIAYVIAGLGWYLSGDPVRFAQVLVVASPCPLILAAPIAMVSGMSRNSRNGIIVKSGTTLEKLSDARTFAFDKTGTVTRGILKVAAILPQAGFSQDELLNLAASAEGQSTHILARSLTDAVPVADRLPATDVSEATSFGVNATVDGHKVKVGKAEFAGTTDTINTTAVYVNVDGKYAGAITFSDQIRPEAKETMSKLHELNDANLIMISGDQQSIADKVAEEVGIDQVYAEQLPQQKIEVLDKLPKSGRPVVMVGDGVNDAPSLAIADVGIAMGAHGATAASESADAVVLRDDLAKVAAATLIAKETMVIAKQSVLIGIAICTGLMVIASFGVIPTIIGAMLQEVVDTVTILYALRARNGLHRQALVDPVRAEARA

SEQ ID NO: 8520 - protein, 147 aa, Lactobacillus casei
MMANDLMRRNDWLDDPFFNDLGRHIFDSFTPSRGGDSSRLLKTDIQENDKSYVVKVDVPGIEKPNINLSYDHGILSVAVKHEEQADHSDNEGNMLMSERSYGRMSRSYRLPNVDEGKISAKVTDGVLTIDLPKLTGDQEGSHQITID

SEQ ID NO: 8521 - protein, 134 aa, Lactobacillus casei
MKITIKPAAVTYLNNHVAKDQHLFLALDDGSSKYSKLGGSCAIGNKYQIVVTDTDDQDYALPLENDAGFNLTTGDPETDYFGSGLTLDFKNASLALRDDSGILDGAVTLNHVTAKPQSDDKRREEMKSLGGKIC

SEQ ID NO: 8522 - protein, 445 aa, Lactobacillus casei
MDNGSHNFQETPQDQQPQRGSKKPKNSGWKLIAIVAVVAALIGGGVGGGTAYWAMNHNASLGVTDTSGKAGTTKISNVSVNQSSASEQAFAKVKGAVVSVVNMQKAESNSDGLDTFGGLEGIFGQGNQQSSSSSSNSSSSLEEASEGSGVIYQKKDGKAYIVTNNHVVSGSDKLEVILSDGTKLTASLVGTDSTSDLAVLTIDGSKVTTVASFGDSSKIAAGQTVLAIGSPLGSQYATSVTQGIVSAKSRTIDVTDSNGNTTGQATVIQTDAAINSGNSGGPLINLAGQVVGINSMKLSGSSSSSSDSATIEGMGFAIPSDEVVSIINQLVQNGKVVRPALGVEVRDLSTVSATQQKSVLKLPSSITGGVVVAGFTSGSSAKNAGMKKYDVITALDGVNVTNTAELHTQLYKHKVGDTIKLTVYREGQQQTVSFKLTQTTSDLKN

SEQ ID NO: 8523 - protein, 269 aa, Lactobacillus casei
VGEDFGMRVSVLASSSSGNATYIETPGHKVLVDAGLSGKKIEKLMQSIGRDLTDVDSVFITHEHSDHVRGVGVLARRYPQISVYANAKTFAALPKSVGKIPEDQLRLFDMGATLTLGDLDVESFGVSHDAAAPQFYQFHHDGKTFTILTDTGYVSDRVAGTIRDADAYVMECNHDLEMLRTGPYPWPLKQRILSDQGHLSNEDGADALMDVIGLRTKRIYLGHLSPHNNNKPLAHLTVASLLAQQGLAVDHDFHLYDTDPAIADPLFVV

SEQ ID NO: 8524 - protein, 265 aa, Lactobacillus casei
VDFRRIEWIFLVVFVGLNIFLGISYFQAQQVDLATIKSGDAATITDITRDQIKLPHLSKKTPQGDYLASQANTALSAARSLLVKQQVTISEGDYQELQASLDEPITLKKNQEQQQLATFVKNNVYHGKEYEYAPALSNDERIVFAQHPKAGLIYDRRAAVTLHVNDNRLVSYTQTYLSKLSVLRDRLNLMSEQDAVIALYRDNDIPNNSAIVSTKLAYSYLLDAKGSTVYVPAWYIGVKNRATGNVTVKRVNAITRTVMKNRSDN

SEQ ID NO: 8525 - protein, 469 aa, Lactobacillus casei
MKLSNWILRVSLIAMVILSFVFTSLIWRNPSRQERRNTSNVQVTTENDPNVKKLEGTIYLPNQVYYTHGGQKQLLMEANANMGRQVRQTMADWHMTKIKTIGKVSSTNYDNYLQQDDSLQLIYQDVMSFKQFEQWYFNKQPNLKSSDFHFNRILLNLETGANRLTFINDATRTVYEAKLTNVTTGQLENLVKKRSTKAFPIEEKRLSGNEVAFFTQPIKLQPYAYLMDQQSANYYVSLLMPSKTASNVDAREIGDSTLYTAGSTRRMTADSTTGAIEFENYAAAFPNNGLANFFHATFKGLSALQMTNLSSMRYFQYDASRGSVIYKTYAQGFPIFNADQKGDVTVRYTQTSEEINFSNTNLTVPIPTNQPAQTLPATATIVNQLVAAGYRASQITDILIGYQWTGSSNDQQVVDLQPTYYVEMKGEYRDYQSWLNHSSASSASAASSQTATPSNNAAAGSSSDSGASQ

SEQ ID NO: 8526 - protein, 636 aa, Lactobacillus casei
LNKKIRFFQSIHFKIAIVFILLLVVTLEMIGAYFVKTLEQQNIEQFKTSVNVDSYIQDKLAADLLRTDTDNANDDIKSTLSQADIANSADLQVVDSKGTIRGDSDINAQTNVGQKSANSNIKNTLYSGQQYEGYEYRDRTGSTYYKVIPIKNPNATGDNNSVIGAIAISASMEQAYDSINKIVGIFLISSLVAGLLGTLLSIVISRAITRPIDEMKKQAIRMARGDYSGQVRIYGQDELGQLAVAVNNLSVRVEEAQEASEAERRRLDSVLAHMTDGVIATDRRGNVIIINQTALNFLNTKNEDVIGVSILKLLNIAKDYTLRDLLEHQTELLLDFSEKMDHDLILRVDFSLIQRETGFISGLVAVLHDVTEQQKIDRDRKEFVSNVSHELRTPLTSVRSYIEALSDGAWKDPKLAPRFLNVTQEETDRMIRMINDLLSLSRLDSGTSKFNLETVNLNEFFNYVLDRFDMMLKTDNEHTGEARTAQPLPQPDGHKKRYSIKREITNEDLWVEIDTDKFMQVIDNIMNNAIKYSPDGGVITARLFQTHDHVILSISDQGLGIPRQDLGKIFDRFYRVDKARSRKQGGTGLGLAISKEVVEALHGRIWVDSQEGRGSTFYISLPYEPITDGGDDWDEA

SEQ ID NO: 8527 - protein, 237 aa, Lactobacillus casei
MAKKILVVDDEKPISDIVKFNLDKEGYDVVTAYDGEEALKKVESESPDLILLDLMLPKIDGLEVARQIRKEHDTPIIMLTAKDSEIDKVLGLELGADDYVTKPFSNRELVARVKANLRRTSASSAANNEEDEANRELQVGDLTIHPDAYTVSKRGENIELTHREFELLHYLARHLGQVMTREHLLQTVWGYDYFGDVRTVDVTVRRLREKIEDNPSHPEWLVTRRGVGYYLRNPDAE

SEQ ID NO: 8528 - protein, 224 aa, Lactobacillus casei
MFFYHNDLKLYYHKSGHGPAIILLHGNGEDHTIFSDLITYLAPHYTVIALDSRDHGQSTRTDQLSYDAMTEDVAALISELSLQRPIILGFSDGGIIALLLAIRHPKLVGALIVAGANLTPQGLRWYSRILFRIAAGHRPSPKLAMMLHEPQITPAMLHTISVPTLVLAGSRDLIARKETFTIATHIQNAELHILPGETHNSYIRDNTKLWHLISPFLAGLRATG

SEQ ID NO: 8529 - protein, 482 aa, Lactobacillus casei
MRGIKHWAVAIVALLAMFIGFTVQQPTPTAAAGDDLAAIQKRGYLIVGLSADYAPLEFHATLNGADTIVGADISMSKQIAKDMGVKLQIKEMNFTALIGALKTGKIDLIVSGMSKTPEREKEVNFSQPYLYETQVMVIRKADKAKYKSIADFSGKRVGAQKQTTQEQLAKTQLPGAKVTSLDKANDVIAQISYNKLDAGVMASTIADSYVARTPSLMVLDPHFATDKAPTAIAVNKQSPALLAQVNKTISKVKGAKYKQYLQAAYKLQDQNQGFWAKYGNYFIRGAIYTLIFAALTVFFGTIIGTLLALMKLSRNWLAKAIANVYIEFIRGTPLLVQAFIVFFGTQILGLDLSAFIAGAIAMAINSGAYVAEIIRGGINSVPVGQTEAARSLGLHQRQAMRYVILPQAMKNIWPALGNEFVTDIKESSVLSVIGATELMFEGTVVQGASFKPFLPLVVVAIFYFIMTFTLSRLLRLIEKRFN

SEQ ID NO: 8530 - protein, 406 aa, Lactobacillus casei
MTEKIVLAYSGGLDTSVAIPWLMDKGYEVIAVVLNVGQPDADFDAIQQKALKVGAIDSIVVDAQDEFADHYVAPVIKANALYEGDYPLVSALSRPLIIEHLVKIAHQQNATAIAHGSTGKGNDQVRFEAAIHALDPDMKIEAPIRDFHWSREEEIDYAKEHNVPVPIGKASPYSIDANLWGRANEAGILENPWNQAPDDAWGMTVAPEEAPDEPTFLDLTFEQGVPVALNDEHMPLAAMIKKLNQIAGANGIGRIDKIENRLVGIKSREVYEAPAAAVIMAAHHDLENLTLERDVQHFKPTIENKLTNMIYEAQWISPLFDALMAFIDQTQAVVNGTVKMKLYKGNAVAVARKSAHNSLYDEDLATYTSADSFDQEAAAGFIKLWTLPTTVFEQVNHVHSEEKQHD

SEQ ID NO: 8531 - protein, 466 aa, Lactobacillus casei
MTDKLWGGRFTEKAAHWVDAFGASIGFDQQMAKEDLEGSLAHVKMLGKTGIIPQSDADKITAGLHHLQKELAAGKLHFTVENEDIHLNMEALLTAEIGPVAGKLHTARSRNDQVATDLHLWLKHRLPEIKEALTNLQTVLVGQAKVHAATIMPGYTHMQHAQPITYGHYLLAYFEMFQRDWERFDFTQKHTDILPLGAAALAGTTFPIDRTLVAKELGFDQLYHNSLDAVSDRDFALEFLSNSAILMQHLSRMAEELILWSTFEFNYIELGDDFSTGSSIMPQKKNPDFAELIRGKTGRVYGALMGLLTTMKAIPLAYNKDMQEDKEPIFDTYNTILGSLHIFTGMLSDLTVHEKRMAQATTHDFSNATELADYLATKGVPFRQAHAIVGELVLKGIKSGTALQEMPLSELQQAAPQIENDVYAELTSKVAVNRRTSLGGTAVSNVLKEVARDEKIIAAHEKKQAQ

SEQ ID NO: 8532 - protein, 366 aa, Lactobacillus casei
MKRLGISLYPDQSSFEVNKAYLDLAHHYGYSRIFTSLLQLSGKDGEDLLAKFSQTIDYANQLGFKTIVDINPALFKELKISYDDLSFFENLHVWGLRLDEGFTGAEEARMTHNPYGLKIELNMSRGTNYLASIMSYDPDRDNLIGCHNFYPQAFTGLSDAIFTEYSQQYRHYGLHTAAFVSSANGKIGPWPIHDGLPTMESDRHRDIVSQTSHLVLTGQIDDVIIGNAFASEAELKAVAATFLTPYPVLHAEMSANMTPTEEKIAFAAPHLYRGDASAYLLRDTQPRITYSAADVPAHDNGQSFERGDILVVNSAYGRYKGELQVVLAPFKDDGQRNRIGRICADDLGFLDLVKPWSTFVLEKLSN

SEQ ID NO: 8533 - protein, 139 aa, Lactobacillus casei
LEIQMMFKVPAAFMYGQLIRSVQADIKTHTGREVLPGSLDGFTYQKKWANGMTGKLTITHAIANERYAYELDTARDHYQVDYQLRDLGDHKTMLHYTETIEGKTAKGKANNRTAGFLLNWQRKHRFKKMSRQMAAQYFS

SEQ ID NO: 8534 - protein, 453 aa, Lactobacillus casei
MNKLINWLNKHVVPIAARIGSIRWLVALRDAFIAIMPAMMAGAISTVLNALIRDIPTQFGWTGFVNSMQWLIGINAVVWTGTLAILGLIFSFTFGYQLAVQYKVEPVTAGIVTLGTFIMSLPQNFTLTLKAGLAKGAVKTLTDAGAVVSGKDVSMWGFFNFGKFFGAYGFFTVMLMGAIAATIYIWLMKKHITIKMPDSVPPAVANAFTGIVPAAVALYGVGIINYLFTQFGTTVIEFIAKVLQEPLLGLSQGYGAVLLMTILVQVFWFFGIHGTNVLGPVLDSIWLTAQLANINAFHKGQSLPYLWTRNSFDLYAWIGGAGSTLLLLIAILMFSKRDDQRAVAKLSIAPGFFNVNEPVMFGMPIVLDPIYFIPFIMAPVVMVSIAYGAVTMGLVSPIKNQIVWSMPPFLNALVATMDWRAAVLQLVNMVIGFLIYVPFVKAANRIKPAQLDV

SEQ ID NO: 8535 - protein, 236 aa, Lactobacillus casei
MYHDIAEQLIQDILAGQYPVKLPTEQVLMDRYQASRNTIRKALDVVFAHGLVRRVQGSGYYVIDHSAQSDAVLNMSIGFDQTAMVKGGPLTSKVVKFALIPATAALAQRGNVTRGAPVYQVVRLRYLKKQLYDLEESYFPQAIVPHLSAEIAQGSIFAYLRNTYHMVGSTTENYIQTLPLPADYADLMGLPVETNHLCLDGINYLASGKVFNFSRTYFVYQGLTLYYHTTNIDLER

SEQ ID NO: 8536 - protein, 109 aa, Lactobacillus casei
MTEKKIMLVCAAGMSTSMLVARMQKAAEKDGITVNIFATSASDADNKLAAENPDVLMLGPQVRYLEGQFKKDLDIPVSVINMQDYGLMNGEKVLKASLKAIDDGKGAAS

SEQ ID NO: 8537 - protein, 110 aa, Lactobacillus casei
MSEEDQSLETVMGLIINGGNAKSSAFEAIHAAKDGDFKLADEKLKEADQFLTQAHNVQSGMLTAEAQGDHAKVTLLMVHSQDHLMNAITFRDLAGEIVALYKRLSTQEAK

SEQ ID NO: 8538 - protein, 183 aa, Lactobacillus casei
MTVTLKHFQTEDLETLWKVAFSDPNAEWHKWNGPYFNDEIPTLKEMQDDQANQTGYQWVANPFVNGIWDDGILIGDVSAHYEDGDLQRWLDLGIVIYDESYWGKGIGKQALDQWIDRIFGLIDLPHLGITTWSGNERMIGLAEAVGMKQEARVRQVRYYQDRYWDSIKYGILREEWQALRQQQ

SEQ ID NO: 8539 - protein, 154 aa, Lactobacillus casei
LADYIKQVRAKVGHMPLIMAGTIGILTDDAGRVLLQQRSDFTGEWGLISGTIEYGETPAQTMVREFKEETNLTVAVVSLLGVNGNLTLTYPNGDVAQWLCPVFLVKQLGGELNSDNDETEALKFFDPAAAPRLFNQQHREALAHFIAGERGYFD

SEQ ID NO: 8540 - protein, 162 aa, Lactobacillus casei
MHQLVILRGNSGGGKTTTAKVLREHLTDTLLISQDVIRRDMLAEKDKPDSPNIALIELIARFGLQHEKVVIVEGKLNAARYGQMLQGLIAAADRSFSYYYDLSFEETLHRHAGRAKANEFGADSMRRWFQPHDLLGVPGEQTIPASWSQDEVVGRILADLNS

SEQ ID NO: 8541 - protein, 207 aa, Lactobacillus casei
MTSYPRRDPVTDQLLTPENSALILIDYQPTQVESIGSMNHHALIQNVVMTAKLAKIYQVPIVLSTVNVKSGRNKDTIPDLKKVLGDQPSIDRTSINAWQDQDFVEAVKATGRKKLIMAALWTEACLTFPTLDALAEGFQVYPVVDAVGGTSKIAHETALRRVEQAGAQLITNAQLACEWQRDWNRTDTVPDFVKILLENGDFINLGA

SEQ ID NO: 8542 - protein, 45 aa, Lactobacillus casei
MAKDQPFRREATYTPISKRSCLRSVKILGAMARLAIAPKDINIRF

SEQ ID NO: 8543 - protein, 473 aa, Lactobacillus casei
MQRFATGSKRWWLLIALGFFAFMTNLDGSIVNIAIPIMAKNLDVSASRMEWTVSLYLIVLSALLLPFGKLGDRIGKRRIFKWGTGTFVVGSLMAGINLGFNFLMVGRMVQAIGGAMTLANTYGIVTSTFALAERGRAMGVVSTFVALGGVAGPSLGGLILAHFSWPMIFLINVPIGVVALGISLWSMDNGEPQPGTYDKWGMLLQATAIASGFWGLNLAQQSGFGDPVVLATFALAIISLAAFLIFENHQETPLLPMSIFRVRIFTLGVLTVFFIFMVQFFSTVLMPFYLEDARGLTPGAAGTLLSLYPLMMVFFAPFGGWLADKWQVPAVALLGSLLIAAGSIVGAFLKLDAPLMVYIISTLLIGIGSGLFQSPIGDVVMSVVPKDQLGIAGSFNALARNLGMVSGTAVATTVLFGTMSQLAGSRVTTYPTNHPEYFIAGLQIAMLVAAGLALLGAIAIGLTIKPWQVHEKN

SEQ ID NO: 8544 - protein, 396 aa, Lactobacillus casei
MEKHHSTTLLTWGILLVGANLRLPITMIPPLLPTIEHTLGLPASMAGLLTTIPLLMFALASPVIAKMGNRRGNEWSLLVALVILLLGSLLRIIPSLIALIVGTLLIGFGISGGNVLLPAIIKDQFPQSIGAKTSLYTVTMGLVASLGTGLAGLLNQQFHMKLTMAAFSLVGVAGLVIWALALRTLPPVKTWQGSARKNVAVSHSLLAWWIALFFGLQSFLYYSLLTWLPSLWQAVGFSQLTAGNLATIFQLSGMPATLSIPFIAERRHGLAYSVWGIMLGFALGALGILIPGANFGLNVIFSLLMGVASGAAFAICIVFFQKKTADAYETASLSGFAQSLGYLFASVGPMLYGFIQTLTGSWNLLLWVTVVLTLIMFAVGLVINATPSIFSASDRK

SEQ ID NO: 8545 - protein, 309 aa, Lactobacillus casei
MALTTTIGKSNVVTGKLGLGTNKVGGHNLFPNLHDEDGLAVVKTALDHGIDMLDTAYMYGLGQSETLIGQAIQGYDRAKIVLATKAAQDPHQDLKPNNDPKFLTQAIDDALLRLKTDYLDIFYIHFPDEKTDKAEAVNAVANARKAGKVRAIGVSNFSLDQIKEANQDQQVDVVEDNYSLVHRDAETKLFPYLREQHISFVPYFPLASGLLTGKYGPDDAEKFSGRFSASQFKTILAALREVDGIADAHQATIAQIMLAWYMKNPDIAVVIPGARLPEQAASNAEALKVQLRDPEYGSINELFKEFRPK

SEQ ID NO: 8546 - protein, 121 aa, Lactobacillus casei
MVQSINTKSELVMEGTAFMGMPVYGKIMIGDKGFEFFNEKNVHDFYQIPWDEVNWVIASVIFRGKWIPRFAIKTKKNGTYTFAAKDAKKVLRAIREHIPADRIVKSLTFWQVVKRAFTRKK

SEQ ID NO: 8547 - protein, 303 aa, Lactobacillus casei
MAEEVHITKSDRIKVWWRSTFLQGSWNYERMQNGGWAYTLIPALKRLYHTKEDRAAALKRHLEFFNTHPYLASPILGVTMALEEERANGAPIDDKAIQGVKVGMMGPLAGVGDPVFWFTVKPIIGALAASLAMAGNLMGPILYFVLWNAIRMAFLWYTQEFGYKAGSKITEDLSGGLLQEVTKGATILGMFILGSLVNRWVSVKFTPVVSDVPNQKGAYIDWSSLPSGKAGIQKALELQSQGLSLTKNKVTTLQDNLDQLIPGLMGLLLTLFCMWLLKKKVSPIVIILGLFVVGVVFHVIGLM

SEQ ID NO: 8548 - protein, 215 aa, Lactobacillus casei
MIALGWANIGAAVAPDAALASVASAIILVLGGQGTKGISSAIAIAVPLAVAGLLLTTLVRTLATAIVHIMDRAAEEGSFRKIDFWQWVAICMQGLRIAIPAGLILAVGAGPVRALLEQMPDWLTKGLGIGGGMVVAVGYAMVINMMATREVWPFFAIGFVLATVKEITLIGLGAIGISLALIYLALSKQGGGSGNGGSSNNSGAGDPVGDIIDNY

SEQ ID NO: 8549 - protein, 56 aa, Lactobacillus casei
MTLNFIQIILVLIVSFLAGMEGILDEFHFHQPVIACTLIGLVTGDLTPCLMLGGQL

SEQ ID NO: 8550 - protein, 337 aa, Lactobacillus casei
EIIABCMPNENTMVGIILASHGQFAAGIKQSGQMIFGEQEKVEAVTFMPDEGPDDLHKHLEDAIAKFDPDDEVLFLIDLWGGSPFNQANTIYEEHKDKWAIVTGLNLPMLIEAYGSRLSMDSAQDIAAHLLEAGRDGIKIKPESLDKVKKPAAQAAAPSTANAGQPGSFQYVLARVDSRLLHGQVATTWTKTTNPTRIIVVSDTVAKDELRKNLIKEAAPSGVKAHVVPIDQMIKLAKDDKHFGGQRALLLFETPEDALRAIEGGVPIKELNIGSMSHSVGKVQPNKVLAFDQKDIDTFHELAKDGVKFDVRKVPSDHPDDMNAILKKAQDELNAQK

SEQ ID NO: 8551 - protein, 423 aa, Lactobacillus casei
MHEYFNNRGYRAILNASLLSGIGDSLYNIVFIIYAATMPFKSLAVTLAAMATTLPTMLSLVTGSLADRTQAKTSHMVATRIGQTLLFLGLAGMILLPASLPLFLLLLGINILSDTLGQYGNGLVLPLLHRLIPAKELNTAISFQSATGTTVQMVFQAVGASLIVLLNHNYALFGGLNAVTFLLAAWVITREKSRLKQAEPPIVTHAHQPILKDIGKVLKFLATNRFLLAVIVFAMFVNTLGSSVDGLMSVSLVQQPGMWLRDFGTTVALLNIVFSVGLILGALFAQDGLQRLSTFKLLSLLTAAMIGLSFSFFLFRSLAAVMGFSFVTSYLMGKINPRVSTVMMRLVPEQQMGTTAGVVNLVALLGMPVGQVVFFTLANVVSAAASWMLMAALSAVLLLVLLLVGTRIADPVFTDSEGQSEKA

SEQ ID NO: 8552 - protein, 339 aa, Lactobacillus casei
MVEKINPTDGAVFRQLRRNHHLTLAQVADAHNSIAFISKFEQGHSNISFARLSHLLFRINISVEEFVFIRDLQAGAVPPSAHTRFVYNTLVHRDFEEVIANQDRLGFENPTLADYQYLLKQEKAWQKRYEHDHNRQTQFELISIQIFRLTMIDRVKPPDQPSPFKNVTDAMAQLQERAKPLVSYLYSVETWNYFELYWFRHLMVALPAETIQNLLPIAMKRSEKYRAFNQIGNLRIQTLFSAFTVFINTRHLTDAKKVLTTAEKILHDTNDLSNSALLLFLRGWYQAVIGQTTAGYELCQQAISLEHILDQPTQEQWLRYLLKVVRINIKDPQGGAYFL

SEQ ID NO: 8553 - protein, 282 aa, Lactobacillus casei
MTIGEQFKRLRKERRLTLKEAAGDIVSVSSLSKFENGTSQLAADRFFLLLDRLNLDWDAFTPSRSDAPLPFLHRYLVAAQQADVQALAGILRQLPLANTNQRLLLHLTLHNHAPERFSVLARERKQAWSLLTHTTEWSLLLRLIALQLTGIIAMKDLEGLIKAIANQVQTPNTPQDHLNLANRAFLTASLRYIAAGQLDNAQETLALIRQATVGDMGIEFQIACTKRLVMIYSPDKSRAARGWQELAQLKAILNEVAASDWTASWLPALEALAEAKRCGKEA

SEQ ID NO: 8554 - protein, 291 aa, Lactobacillus casei
MAEEPVKVGAYLRALRLEENDSLEEIAAGITTAATLSRFERGETQLSAAVVLKLLTRFDQDVELMQQGYRALNPENFFQQVNRATVAGKSALQVLAQKQYRLWRQTGLIFYRLNQINILAHNGYTDPSFQTTPQMKADVIKYLKRIRYWGLYELDLFAATLVIYDHEQLMSLVMELVLDWPDVKGHPTRNQYLWAILTNSIALLIHRREFTDAVRLLNVAKNLPIPADDLYARIMLRYQEHLLTYHRGQHRAAKMAVKNLLATLALLDSPFFAQLLTKSWRRFLKEEAQAK

SEQ ID NO: 8555 - protein, 260 aa, Lactobacillus casei
  misc_feature (4)..(4): Xaa can be any naturally occurring amino acid
CAAXAMINTERMINALPRTEASESELFIMMNITYLGKIISIGGSLLKHSLLLTGILLLDILTEFHDFFTISKLQQDQYEVLVIELILKGAFIWFLHWLYFRQLKRFNPNGYGLKPLSRKNILIFLIGVASLFGLLCVESLTPFNADNATNQVLVNKFIRTAPLLASVDAVLAAPIIEEFILRGIFFNYFFNKNTIMSKIFVVLVSGFVFGLLHEPHFTVNLLVYCTMGWLFGSVYALTGDLRYSIALHILNNVLAFVSMF

SEQ ID NO: 8556 - protein, 533 aa, Lactobacillus casei
MKKHWVARLGVLGLVLSLLLGGFAAKPVNAASDDNTFKVGMEAGYAPFNWTQNTDANNAVKIQGSHEYANGYDVQIARKVAKALHKKVVVVKTSWDGLPPALTSGKIDAIIAGMSPTPDRRKTIDFTNPYYISNLTMVVRKDSKYAKAKSIADFKGAKVTAQLSTYHYQAINQIKGVVKEPAMNDFPAMRVALESGTIDGYVSEVPEGITAERANPNLMYIHFAKGQGFKTDASDTNLAIGLRKNDPNKAKINELLATISKKDRARLMNEAVDNQPSTEKSGNWFMAIMKQYGPMLLRGTGMTLLLALVGTLVGFIIGLLVGIIRTTPKPKKLGQRGLRAVINWLLSLYIEVFRGTPMIVQAAVLYYGAAQAWHLNMDRTTAALLIVSINTGAYISEIIRGGIISVDEGQFEAASALGMTHLQTMMKVILPQAVRNSLPAVTNEFIVNIKDTSVLSVISVSELFFSGETIAGQSFQFFHTYLIVSGIYLIMTFTISRLFRLIEKHLDGPKDYNVMNNQMQVETPKIGTAKEGD

SEQ ID NO: 8557 - protein, 248 aa, Lactobacillus casei
MANEPLIQVKNLKKSFGNHEVLTDINFNVQAGEVVSIIGRSGSGKSTLLRNINLLETPTGGDILFHGKSILGEDVKLSTYRAKVGMVFQSFNLFNNMTVLQNVMVPQQTVLKRDAAAAKTHALELLKQVGMDPFIAAKPDQLSGGQEQRVAIARAEAMDPEVLLFDEPTSALDPEMVDDVLNTMTALAHTGLTMIIVTHEMAFARDVSDRVVFMNNGIIAESGTPDQIFGNPQQTATKEFLKRYLNRV

SEQ ID NO: 8558 - protein, 92 aa, Lactobacillus casei
MGLSGEIIVGGLPPTMRPIFEPQPVLLRLKVVPTTLASRSPSLIWPEIAEFGTTIYYFVFRFFSRCSRHVSRLTTMKNRKKPPTTDSAVSKR

SEQ ID NO: 8559 - protein, 81 aa, Lactobacillus casei
MTTFKRILKRTLIYNVLVLGLAVLMTFGYVGYQDVTAGKGYLALRYLLLTAESVVGGFFLFFIVVSLDTWREHREKKRKTK

SEQ ID NO: 8560 - protein, 423 aa, Lactobacillus casei
MKRRWLLGVATALMVLLLTACSSGSSAQKTSKGPVTITFWHRMTGNYNKALEGYIKTFNSSQKQYKVVATSQGSYDNLQKKYLASAKSKTLPTIGQVTDTIIPEYVHDGMLVNIDKQVKSQFSAAELKSIYPGIATNLKYQGNYYQIPFATGTRLMFYNKDILEKYHLTVPKTWEELTKIGQQLKGDGITGVAFNKSYDFEFETLAYDAGNRLITPQYKAKIDTPASIKAMTAITSMLQDKTAVTAGLDNYFNVPFVQGKIFAGFGSSATIQQIASTAPKSMHWGTAVMPSFDGKSSSVLGNNGISVFKGASAEQIKGAVKFMKFLMSTKIQTQWAKASGYVPVVSTATKSSDYQAYLKANPNYQAAVDAYDDAFSSTPFIGYNTYRNNLLDAVDQTVSKKAEPKTVLTTLQKQAETISKDNR

SEQ ID NO: 8561 - protein, 240 aa, Lactobacillus casei
VDRTSLKNQAKAELNPNFSYYLRISLPALLLMAFATLVPFPAVHEAHRGTWHTWRMMAQSGSFTVTGGHVNEYWQMWQSIVIFLSLLGVLLMIGVMFAMIDGLRGRSDHQFSWMQMFKIFERGEYFLGSLLIGLLQWVWIFLWMFLLIVPGIVKAMAYSQAQWIYRDAIDSGQPIGYTEAVTRSRELMFGHKWDYFVLLLSFLGWWLLELITMGLASIWVIPYRSMTLANFYLKLTEEQA

SEQ ID NO: 8562 - protein, 112 aa, Lactobacillus casei
MELNISAQAAARLAPLLHADRVLVLDLNDGIGPYSRQYHDTSQAKFSLLILPRRNVPDVFDAHLDSPVGPVLIKSYAAGFFDSKTELTVSGDEFTLLRGKPRLNPKVPLKFV

SEQ ID NO: 8563 - protein, 107 aa, Lactobacillus casei
MNIYSALKFIQIDHAQVNHLQVVVTDQSGKPDAGMTDLLIDCLNKIDIFVDLSTTDRVSDVIDDLNLLTPLPYDVLEEYQKILEQPINGINVAMKKQLIEFIYAPTV

SEQ ID NO: 8564 - protein, 156 aa, Lactobacillus casei
MNETGHALPANIKFVWRADIFIWSFIFFVVGLLLLIASSFWHWPSWLGFGVIGLTVLQYIIRRALVPYRYRFLRYNITPTAVFLQKGFFFRKNEAIPIARIQNVTLEQGPLLRWQQLQQVNIETASTAHVIDGVTASVANQLRTQILKLAQEARDE

SEQ ID NO: 8565 - protein, 507 aa, Lactobacillus casei
MNEQPHHLAPVALLILWVKNVVALWPIFVGGLFSMFGSKMSFKELLFWLALILGSVTLMLGWSILRYLRFTYSVAPDGLTIQSGVFIRKTNHIPYDRIQTVQRQQWFFLKPLRLEQVSIETAGKETRKAEGQLAAVPTAVADTINRYRQGISAEPTTSSAAESVDADATTQTRVVNTEPVPDAAYKINSHDLNQYALTSLGFIPIITGILWVLDKAQEYLPDSWYQQAEHAITGLAIYLLIGLSIIVLVLGFAVSYLNILQKYYRFTLVRTGNELRTSRGFFQTNTVSARLSRVQAVRFKQSILRQWFHLTTVQALLASGAADDEQNNDLVLMPVIRQRSAMTDMRKFISWLPTAIPELQPIPVRNRWYYVRNMVLGNLAFIVAPIILTSVLWLHVSWWVWLLPIGGLWLLIMALQGQYAATNAAIAIAPPDQLVIQVGEVWTRQRYYVRKKDIQAMSLAQSIWMKPRGVAHLNIHVRKGNSDQTITSRYMKADLAKQILSWYQPLP

SEQ ID NO: 8566 - protein, 258 aa, Lactobacillus casei
MLLNKIQYTPPLQATSYPFNLPWQAHFRELKLTQPVTILTGDNGSGKSTLLNAIAANYNAILMSGASLEDDPEYDNSRALAHQLKLTWTYRTKSGFLFRADDFISFIRATRGRIKYAQDQLEHLAPKSLERLPYLNTLAEVRHLYKVDLDTLSHGQAFLALFRARLHANALYLLDEPESPLTPENQLSLLALIHEAVTGGAQFIISTHSPILMAYPDAQLLALGDTLAPIQYDQIEHITFLRSFLDDPQRFVYHLLHD

SEQ ID NO: 8567 - protein, 295 aa, Lactobacillus casei
MLTSAWTKQLPLDHITSITPVGGGDVNKAYRVDTSEKPYFLLVQPGYPASFYAGEIAGLKAFEAAQVLAPRVIANGSIEGDGYLLLSFLTSGHGSQRELGRLVAHLHQHHEPAGRFGFDYPYAGTSVSFSNDWTDSWADLFIHQRLDKLAAHILKKGLWQADDQATFDQVRTIISKTLSQHHSEASLLHGDLWGGNYMFTADGQPALIDPAAVYGDRELDIGVTTVFGGFNQEFYAGYQETYPLEPGYPFRLDFYRLYYLMVHLDKFGMAYAGSVAAVMDRILDHGVPENQERND

SEQ ID NO: 8568 - protein, 80 aa, Lactobacillus casei
VDAYSERIEVKRITVHGLRHSHVSLLIRLNENPLQIKERLGHKDTETCSANMVIYTPTANFEVAKKLNGIFSKGVPDEPK

SEQ ID NO: 8569 - protein, 257 aa, Lactobacillus casei
MSRIDKYTPFLKVELKALFREHTSMFFMIIVPIALTVVFGGTFGDSPTIFGKNVLGIDTVVPINVVFLLANTGLMGISITISDIKGQGVLKRYMTYPVTYWQYFQSLFAAFLVVSIISTAIFGGMSFAIYHAIWRMNVGQTLLFIFFYFLTALIFFSLGYLISLFITSSRTASLVTSGIFMIFIFTSGIAIPTDSLPGFVQKFAHVFPMYHCIQVMQYLWVGDFELSKIGNNIVYVLILSVLMVIVLKKVRIQWDSK

SEQ ID NO: 8570 - protein, 286 aa, Lactobacillus casei
MTLLRIDHAKKVYKKRTAISDANMSFNGKGLYLIAGPNGSGKTTLLESIVGLRRLSSGSIVVEPNTAKIAFLFQENNLRKLNTVREEFQLVLKLYQRNISERQVADQYHLTEFLDTRTANLSGGTKRRVLIAMTLMTEAPIVILDEPASGLDTFNRKEIWNLIKQYGKNHLVIVSDHYLNQAADYCDFVYMLHAGKIVESGLIPELESQLRKFVYTPIDVNQLRPIERDLKEQGIDYISRSTGKNFYLYTDSSVRTSNILNNHHVSIHSLTFEDGYLMYTGDDVNE

SEQ ID NO: 8571 - protein, 246 aa, Lactobacillus casei
MSQYRVEMKNVHKSFGDNDVVKGVNLNVANNEVVVMIGASGAGKSTVLRMINGLETVTSGEILVDGEDIAHKGTDINKVREKIGMVFQHFNLFPNMSVMGNITLAPTELGIVSKDEAVKQAKEMLEVVGLTDKADAMPAQLSGGQQQRVAIARALAMHPDIMLFDEPTSALDPEMVGDVLGVMRRLAKQGMTMVIVTHEMGFAKEVADRVVFFDNGTILEQGKPEDIFEHPKEERTKNFLNKVLNA

SEQ ID NO: 8572 - protein, 469 aa, Lactobacillus casei
MLGALLPGKTVAAAQKTYTIGTDVTFAPFEFANQDNKYVGIDLDLIKAIAKEEGFKVDVKPLGFNAAVQALEAKQIDGVIAGMSITPERKQKFLMSDPYYKSGVVMAVAKKSTIKSLKDLRGKRVAIKTGTDSADYANSVKQKYGFTTVTFDDSNNMYQDVTTGNSAACFEDQPVMQYGINNGMALKIVGKPAREGAYGFATSKNNQALMTKFNAGLKKLRANGQYDKIIERYLGNGSAKSQKTAAGNSQTTDRSFIGLLKANWSTLMGGLRETMVLTIVAIFFATLVGILVGLLGVIPNKLCQGTATTFIYIFRGLPLMVLALFIYTGVPSLIGSKVPAFIAGIVTLTLNEGAYTAAFVKGGIQAVDPGQMEAARSLGLPFGKAMRKVILPQGIKIMIPSFINQFIITLKDTSILSIIGLLELTQTGKIIIARNMEGFKIWTMVALIYLIIITLLTWLSNWVQKKVKA

SEQ ID NO: 8573 - protein, 136 aa, Lactobacillus casei
MRQLMINWLCAKPASCLIDTGLIQPRLRSSTRLSAAHLLAFWSILNLLFMLAEWNSDCPALMLAFLTFVTLFYASGLDLHAPLDPVTEPGQECDNNQVNERDHGPDFEPFHVTRNDDFPGLGQFQDTDNRQNRGVF

SEQ ID NO: 8574 - protein, 486 aa, Lactobacillus casei
MRRVWKWCVAGVAALVLAIGLTMPVSTQAAKKTYVIGTDVTYAPFEFADKNNRYVGIDIDLMQAVAKAEGFKVDIKPLGFNAAVQALEAHQIDGVIAGMQITPERKQKFAMSDPYYKTAVAMAVAKNSGVKSLKDLRGKRVALKTGTAAADFAMSLKDKYGFHTVTFDDSNNMYQDVITGNSVACFDDKPVLQYAIATGLKLKLAGPESKASYYGFATQKGRSDQLDQRFNAGLKKVKADGTYAKIVAKYLGNGTQAAQKETSAKTQDTDRSFLGLLRENWGTLMNGLRETMVVTLVAIIFATIVGILIGLLGVLPNRFARGVATTFIYIFRGLPLLVLALFIYTGIPSLIGSKIPAFVAGIITLTLNEGAYTAAFVKGGIQAVDAGQMEAARSLGLPFGKAMRKVILPQGIRIMVPSFINQFIITLKDTSILSIIGILELTQTGKIIIARNMEGFKIWTMVALIYLIIITLLTWLSNWVQRRMKV

SEQ ID NO: 8575 - protein, 182 aa, Lactobacillus casei
MFSYLIDYDLKLALPRPEIDGPLLFEQIETSRETLSAYLTWVDATLTADDEINFLTTELKSFGEQKSLTLVIHQADAPVGLITLNTIDQLVHHKADIGYWLTTPARGKGVMHKSVKAIADIAFHDYHLNKLIINAAVTNDASNHVAEKAGFHLDGILRQEDPNPRGGFFDVNTYSLLRSEWS

SEQ ID NO: 8576 - protein, 207 aa, Lactobacillus casei
MKERLKYHLNVIGHYLLIGWLIFIVMTILVGLLSYIVMKSNPHFVRGLMTGLSAKFPGATDNWHAFWAILLNNERVTFTMMLVGMIPIPFLYWISYVVTCASVGLVLGIYAAKLGISGAFGAFVLGILPHGIFEMSAMIVAVALAAQVNKALRQSIKRFFANPHYEKSPLDAKAIAVQYFAIVVPAIAFAAIIEGFITPVLLRLIVH

SEQ ID NO: 8577 - protein, 311 aa, Lactobacillus casei
MEINEAQSIFSAAQQQVATIVVGKPMPIKLAFTALLANGHVLFEDIPGVGKTTLVQAIAKTLAMPFSRIQFTPDMLPSDVLGTSIFNRATNAFEFQRGPIFTSILLADEINRATPRTQAALLEAMGERRVTTDGHTYPLSPDFFVMATENPTDYAGTYPLPEAQLDRFMLRLSLGYPDAAAEKSLLLSPDRQTMIAALKPRLDPATLAASKKLVTTITVTDAIANYVLALVEATRTDQRIRLGISPRGGIALVSAAKAFAMLNGRSYVTPEDIQTLTIPVFGHRLIMKDPTSSSTEILTDILQRITAPVRG

SEQ ID NO: 8578 - protein, 330 aa, Lactobacillus casei
MHWRNFYINSALVVLLSLLVGFGMTFNSPTSWFVSEFALMLLLLLALPLLWPMRGHLRFTPNQTTMIAERPTMRHLTLTKGRWLPNLFLLDAAKTSTWHLPVGQRTAKVTLQLPRGVYDQLPFTVTVTDFFGWFRKTLPMQLTTPITVGPVRQPETAAKIATDFSQKMAASDAGLPSDRIKNFREYFPGDNIQQIAWKISAHADSLIVHDDEYEGQTAWTLLLVVTPSLPLESALTLFASLLDTGIFSGDGYLLDQRLTRIPRGQQDALLAGFHPEGVANPAALVDLASPQHHRAYLVLTADSATATPFLQALSPAAATLISLSGGDEHA

SEQ ID NO: 8579 - protein, 719 aa, Lactobacillus casei
MPKWLQRLIMVLLTWWLLFLFLEPFADINPIGHPRALVVYVIGISLILYVATFWPRWWPLWGAMTVAAMIGGLWAIVPLKQPFGISWFSAYLQTFSAATSKFLRVGGVDVPTVLSMTLIITLVAFLLLLTVVVRFYPGAIAIVLSYLLAVHIFNGNDLTAQFIQLAVLTGLMAMLHLYGNHWWPLLIGCTLISGVTLGLAWLSSATPLNEQLANMSVPFRDRLNQRGFYAGIQTYVNGPGRTGYTENSRVLGGPVYDDPTPVFTATSAEASYYRVAVDAAYTGTGWQPGVDQSQTVPLDGAIMRDPNASVDYGPAQSTTLTFNGSKSFLPLPYGQLTFTGGQPDPTTDFLLNAATRRVSTTNQAPFQRLDIQVQAKQITAAQLTAATSSRQQVGSRYLQLPSTLPKRVKQLAEKITAKAPTPYEKVLAIQNYLKSDPRFTYSKTDAQRTPPGHDYVDYFLFDSPIGYCDNFSSAMVVLCRSIGLPARWAKGFNTGTFIGGSGQHKQYVIRNSNAHSWPEVFFNHLGWLPFEPTPGFNDPATPEENIPSSSANNSVANSMPSSSSMSSSASISRTPSTGSPSATKTHSRSSLSNVTWLGILLLIVILLLTALAFWQLPALVAWLIGIGLTATNFPRRYRLLLWSLRRIQHRPVSQTLSAYAKIIDRRLGEQTNMSTLTDAYEQMIFGKMTVDVRPLILPLQKLRGQLVAYTSRRFHVKHR

SEQ ID NO: 8580 - protein, 369 aa, Lactobacillus casei
MKVMIVLENIVMDGVKRASTVLGNDLVKQYDVSFYTLADAPAYFDLNAPLIIARRPTDPKLLNFFGSDPYTHYQDQIEDLIATIRDQHFQTVILPAGLTTSFAPLIKRALPDVNLIGWMHNNYATYMEDYYVQMQAEFEGGLQAVDTLVTLTESDLNSYKRFNPRTVKIYNPLTLVPTGEADLDAHRIAFTGRIAIAHKGIDFLLEAAASLPDDWKIAIAGGGTDEDMKNFYDLIDYFHVSDKLIYQGPLKDQALRDHYRAASIFVSTSRWEGMPLVIGEAMASGLPVVAMENTGSREYLGNNQYGLLTKAQDVPDFVANLKKMMAQPELRQHYAHQSLERASHFSPENIVSQWMPIIEHQPTRTKVAG

SEQ ID NO: 8581 - protein, 464 aa, Lactobacillus casei
MRIEEDCIGKLAVDEDVLYGIHTTRALANFPISHERTDPLLFKSLIIIKKAAAQVNAAAGTLTAPKAKAIIAACNSLLMGEHNDALVAPAIQGSAGTSVNMNVNEVIANLASRHTTERVHPNDDVNQCQSTNDTYPTAGKMAALQALPPLQQALTFLVKSLLVKADEFADVVKVGRTQLQDAVPTTFGHTFQAYAHLFQRDQVRLTRAADDLRVVNLGGTAIGTGLNASPYYREHIVRQVNRLITLNLEQAEDLVDATQNCDVLVAFSGAMKGLATDLSKFANDLRLLSSGPQAALNELHLPAKQAGSSIMPGKVNPVIPEVVNQIAFQVIGQDLTISMAAEAGQLELNAFEPIIFRDLLQGERYLARGIDTLTTNCVTGLTVNQRQCAENVEHSAISATILSPYLGYEATTKLVKTSLEKHVAIPELLRRQHQLPDTLIAHLFSPAVMTNEEPVQKEAAGEKR

SEQ ID NO: 8582 - protein, 196 aa, Lactobacillus casei
LVKKIVNHLTVTNRQQFRKWLATHYQDATECWVDVKRGVPKPDGTFWYVDAVEEAMCFGWIDSTYKKLAPDQPASQRFVPRQTGSIWSELNKERCRRMIHLGRMTPAGYAMLPNMDPNSFKIDASIVRALKRRPGAWAYFQSCPALYQRVRCDTIQIKRNQPKLFRQRLTKFANACQAHRMIGQWNDGGRLPVSDV

SEQ ID NO: 8583 - protein, 139 aa, Lactobacillus casei
LTNQGKLTVYFEQPFYRGLFEQVVGDTYRVAKVTFGTQAPTTNELLCLIQQRWSSLHWVAAQESVLSEVPLTMNPKRRSRQARKEVRNSRKGRASTLLKLEHKQNLRLKKQRRKRLKDQHAREVRLKKQTKRLEKHRGH

SEQ ID NO: 8584 - protein, 392 aa, Lactobacillus casei
MAKKDFNQLALTQAKQYGGKLSVTPKVPIETRDDLSIAYTPGVGAVSSAIAKDSSLVYDLTTKKNTVAVVSDGSAVLGLGNIGAEAAMPVMEGKAALFKRFAKVDAVPIVLDTQDTEEIIAAVKAIAPTFGGINLEDISAPRCFEIEARLIDELNIPVFHDDQHGTAIVVLAALYNALKVAGKSIGDIRVVVNGGGSAGLSVARRFLAAGVKHMMVVDKVGILAEKNADQLPPHHAAIAKITNRENRTGTLEDALKGADVFVGVSAPHVLKPEWIKTMADKPIIFAMANPEPEIFPDQALAGGAYIVGTGRSDFANQINNVLAFPGIFRGALDARARKITIEMQIAAAKGIASLIPDTELSTTNIIPNAFDGDVAEVVAESVRHAAKATVEG

SEQ ID NO: 8585 - protein, 441 aa, Lactobacillus casei
MANKSTTAKMGSGTQGKWMGFKVGSVPLPVYLVMAAVIVLAGVMQQLPVNMLGGFAVILTLGWLLGTIGANIPVVKNFGGPAILSLLVPSILVFYNAMNPNVLKATDMLMKQANFLYFYIACLVCGSILGMNRKILIQGLMRMIVPMMLGMILAMGVGTLVGVLLGLEWKHTLFFIVTPVLAGGIGEGILPLSLGYSTITGTTSGALVAQLIPATIIGNFFAIMCSGLLNRLGEKRPELSGQGQLVRLNGAEDDLADALKDDTGPLDLKMMGAGVLTACTLFILGMLLQSVTGFPGPVLMIVAAAILKYLNVIPGETQRGAKQLYKFISSNFTFPLMAGLGLLYIPLKDVVGMLSWQYFIVVISVVFTVVATGFFVARFLNMNPVETAIVTACQSGMGGTGDVAILSTANRMNLMPFAQVATRLGGAITVITMTAILRIVF

SEQ ID NO: 8586 - protein, 516 aa, Lactobacillus casei
VKIKGWRLWGWLSLIFTSTLLVTVFTVYGLTMLENRQQFETREGQLLLAIGRQLAREPRVIAALEADHADQATRSYANTLAKNFNLDFVVVMNMQGIRLTHPDPSQINHHFQGGDEVTALRGHEHVSVRRGTLGRSLRGFVPVYRDGKEIGVVALGIKVTALQTLIHHSQIGFRLALLVGLVMGILIAFLVAYYIKRQLHDLEPREIARLLEERNAMLEETKDPVIVIDLNQKIMLVNKAASKLQNHLIPQSAFIGQPLTALITHPEHVKLTVKTEQFYQQDGQDYLFSAAPIMVKKQKIGYVIFLRNATEAIFVADQLANTTSYANALQSQSHEFMNKLHVIYGLVAIEQYDELAIYLQDLLKPEQEFANRLALLVKNPLIAGFMIGEREKFSERKTTLDYEIFPELPANRNVAETKTLLTLSRYLHFALLQHDLPDSMLIQLDYADNRLTITYHLGTITNRDALLSFVHQAYFQQLLSDLHGTITFNQDGPLVLKLVVDYHGDDLILNEKRENT

SEQ ID NO: 8587 - protein, 227 aa, Lactobacillus casei
MTSILIVEDDPMVQFIHRNYLEKIGTFSNIYSSDTIAEARNLLATRSIQLILLDIRLKDGNGIDLLTELRRTKQTVDVILITAANEVEIVNDALHLGVIDYLIKPFTLQRFEKSIHRFYAKNRMFDSDQLNQNQLDAYLEPQSHASAPLELDKGLSMATLKIIQEAIAQLPQPFTVPQLTAKTGLSHVSVRKYLNFLETHRFLKSDTIYRKTGRPFKTYKLLTTLPI

SEQ ID NO: 8588 - protein, 278 aa, Lactobacillus casei
MEISNSKLGQLFSPSTLRKLIDDPTMPFITRLKQTQNAPIPNKKLFDEAYALMAKQYRNEYFFKNTLLNKILLGRHSIRTSTAIRELPVAGSILDFLIINGVGQVYEIKTKLDNLKRLSSQLSSYYKAFKYVSVVTDNSHAEVLYEQLQGTDVGLVVLTPRQTLSTLIEPKEHLADLNQAVMFKILRKSEYETALLDYFHVLPDVSQFEYYRTCLKWFEEIDVEICHQYLLRALKTRNNVRKHEKAFNNVPTSIKELVYFQDYSQAEYQQLFTMLDQE

SEQ ID NO: 8589 - protein, 307 aa, Lactobacillus casei
MYYPYLRGKQFELIALREMLNEHTLKSRVVPIIEPIKASSTLKSSLRSFNDENHDLAVIQNPQVTAYKPFVDNKEVTSLKKERSFIPAVIGTTEQAVATLSEYDNPKSMIILPSNAHPALNWQSLVWKQAIKVIAPDNRSLRRHANGEVAVLEDAFDKESRNADYADRGEQFFSDTHIYYKQDGYTGFSDYSVIGSEYVDKGFAPRAVAIHIVYFRKDEELWIRHFVSKTNDDINDVPGKFAEALEALMEWYHSPNFDHDRNDSRALKEFETMSKLKQYSGLGVVKKLSIKHHLEIMGRYLAERADA

SEQ ID NO: 8590 - protein, 374 aa, Lactobacillus casei
MKCCLNCFRDIQIRNWIQRVGEEGCCDVSSRHRAQLTKTIDLDLLERDASYMEGFQSEFIEIFDLYIPSESHHIHHAQKLSAQLRDHWGIFNLETNELEVLLKYLAPTYFRDNPKMLQGLVIPLHVTSEEYQLELGIFSGKSWAEFENIIRHENRYHSGIMVTKNLTYFLQFLVISIAADETYYYRARKISEIDLPQLDVHDIATIGPAPVVKAGAGRLNAPGFSYLYLGSNETTSLVEIKTAIRDLVAIGTFKVTTPLQVVDLDGLVELSPFGGVDKMAYLVNRPILLDIDKAMRRPSGRNRSEVDYVPTQFISDLIKTMGVDGMRYASSVDPLAFDLVLFRTDKISLAGNIKIYEIDQLTPHRKPVDTKYLS

SEQ ID NO: 8591 - protein, 183 aa, Lactobacillus casei
LKRKHLVSLVLIVSVLALVLVTFVSLRHQGPKNKRDPGADAKGFLIKLPGNFEIVKSGIGPFLIERIPKKLQTTTDANTLLYHVQAAGWHGQVMIVKAKEDDNYDFLKSGVSGEGYALINLHTGKRVWAHQLASLHRRYPETRRIRVKPLDHYHWRNPSKQLPKSEDNRVITSRVFTNMVTSH

SEQ ID NO: 8592 - protein, 320 aa, Lactobacillus casei
MKIVLLDGYALNQDLDWGALCNLGECHFYDRTPNDDAKILARIGDADIILTHKTPLTAETIRTAPRLRYIGVMGDGYDVIDTEAASERHIPVTNVPIYATDAVAQFTFALLLEITSHVGLHNRLVHEGKWPTSPNFTFWAKKLVELKGKTLGLIGYGRIAQKVATIAHAFSMKVMFYNHRPKPHDPNISQQVSLDELLKQADIISLHVRQAPETLNMIRHETIEKMRPGTIIINTARGKLINEQDLAEALNNGKIAAAGLDVAQQEPISPDSPLLTAKNCYITPHIAWAPFETRERLLDITVANLKAFLEHHPQNVVNAK

SEQ ID NO: 8593 - protein, 285 aa, Lactobacillus casei
MKITFIGVGDMGSHMVPHLAKAGYDVVIWDKVPTKMAALTGEHVTAAKSLEDAVTASKVVITSVMSDDVPALHIGTPEQPGIVHYLQPGSTLIVTSTLDPRKITAIQSVMPANTKLLDVPMIGGVKYAREAGLVLIAAGDKQAVDAVLPVLKTFGTVKYVGEQGNGAKLKLITNVAIMAAEAGIRETLDLADAYGIDYATTLDLLQMGPLKPVVIRALDESNPRPLKDSVADEVELDNATKDFVDLPIASAAMRRLQKAVDSVVGEAQFIDITNKKTALPDTSKK

SEQ ID NO: 8594 - protein, 132 aa, Lactobacillus casei
MHEDLGSYAYVQRVYNANMRLADYRLPATAKDGTVKFFDDGLIKLTMQIANGRVTKITIVTTNPRSSAYMQVFEGFEFGFDAVSTWIRNYEETTRTHGPSKGIVKGILADYNTTADNVLTVSLTRVAGTAPE

SEQ ID NO: 8595 - protein, 309 aa, Lactobacillus casei
MVKRLLSASTSEVMQFNGQELKESIKASEGRIIVSENIVTQENLDSITTAEIAAAFGADMILCNRLDVYNPKIFGLYPGERDLYSAPKHDGKASIARLQKLVGRPIGINVEPIGDHPNMMENQISILPGCTASEAVIKKAEEMGFQFMVLTGNPGTGVTNAEIAHSIALAKTYFSGLIIAGKMHASGVDEPLMSEETAKRFIDAGADVILAPAVGSIPGFDEAALKAEVQVVHRAGGLVMSAIGTSQEGSGSRVLQEMAIRNKICGVDMQHVGDSAWGFESPVDNLYAVSKAIRGERHTIQRMARSINR

SEQ ID NO: 8596 - protein, 491 aa, Lactobacillus casei
EIIBCACMPNENTMEKHERIGNEIIANVGRLTNVGSVARCYTRLRIRIKDDAKVELDKLNEIEGVVKAFASEGKVQIVMPGYLDKVFEYINAEFIGGSRVSEAGSAVRSVEVVDKNRKPFTLKRLLNGVLDAISNSLTPVIGGLAMAGLFLALLNLLTVSHIVAQGSQTYRLLYLMGNSLFYFLPFLVAYGASRYFKTNTILSLMLAGIMMQPDFVKMVSAGSAIHLFGIPVAAVDYSTSLIPILVTVWVQSLLEKVVDRPWMNKFGLLKMFPVFLIMAPLTLLVTGPIGQGVASVIANGSLWIYDQAPVVGITLLSLLIGFFIITGSHWVFFPVAIANLKQLGYDPFLWVAFAVWNFAELGMALAILVKGKKRSVKTFSATAAFSIAASGITEPAVYGLMLKMKKPIIPSTIASGVGGLFFSLCQVKVFSLVTVSILSLPQFINPAGGNNFVLAVVGLLLTTAVSFVLNWFWGIDESMFDEDEIEAAAEV

SEQ ID NO: 8597 - protein, 284 aa, Lactobacillus casei
LKILQVLNNNVLLVADGHDKQQIVWGKGIGFRLKRGESYFPTEDDHIFRAVPPRDVQWVDTFKELANEIPQSYFELTDSIIDLAQSRLNVSFDGHLLVPLTDHIYFAVQRAKSGMVVSNPMLFDVQRLFQKEFQVGQEAVDMIQSHSQVAFSDDEAGFIAMHLIEHELVETNGPVQTVAEAMAILSGVNEILGEDYGAKFSESSLAVSRMATHLYYLLLRTQEGKYNDSSESSDTILLRQLKKQYPYAGKSLGKIVAFIADKVGYRFNDSNQLFLLIHIIHIIE

SEQ ID NO: 8598 - protein, 56 aa, Lactobacillus casei
MPRKRAVIQPKGVEVSLLNGAGTNEGVAHKSRETKGYRKGKRSQGTGIVTLTMRYI

SEQ ID NO: 8599 - protein, 612 aa, Lactobacillus casei
MVEKTISHQQLLKRLGQYFRNRRVGRGLTLKDVSGNLSEATISRFERGELDISTGKALALMVRLGIDEYDLLTLYDSDPINFPLSLQEPIQMSDFRILNQREKAFFLAHPNQNEMTALARILFEAGKWWPDAHYRLTAEEEQMIADRMAVPERFDLLGLELYKAIVGPASHELLLLLRQRAKRVQSDWRALSFMQLLMLWLGALMNRDMALATVIETDLKPIIKQYHDTAQVIEFYPNWQYGLAVKRWLQAPTVANVARIQQIITDLRERNVETDARWFELMFARTQAGSVHHNPALKDRPKKIVLSRTGGEILKTRREYLGLTRADLKNILSVTALRRFESGQTQLSFGTWVRLCGELALVPSQVLSLPNQLDAKHSRVPGSISLRATFKQVANIPMGSAHDIEAEKVIARFNGQLPELPKSILDTQQFILRSAAHLAPPTGVEMQKEASIILSHLLSMNEWGSLETHASAELVRWLQPAQLVMLFQKARRVIGKHPWTTVGVNYIFDGLNRAILQVVTEQPHDVGCSFLSEFKWLLTIGNPSPMRWQAMGSWLIGRYVTAPSSVSEEAVMHYVDQSLRVGHPDAIDKLKVLWHDELPTNFLDSFVRKFSH

SEQ ID NO: 8600 - protein, 84 aa, Lactobacillus casei
MQTRYGKIISCALFWFNHLVSKTAAYVMLIIAIYYANGAYMQESLLRFTSFDKLAEKVSYWGRNHGREDDQSSAVAEEIGPVFS

SEQ ID NO: 8601 - protein, 390 aa, Lactobacillus casei
MTETQSFIFCTHCGAKNDATSKFCIKCGQPLAVTADVSGSATVGDGVKQSLKNKSNGVIDSATSHLNEWTGGKGAVKVSLNQFFGQVFQRHTTEEAEEIFIVGTKKTTPSLAKVVSDQVQPWLFSRVLLFTLAAGLLLAVVNSLNGKMGDQVAMDVVLSVAVPASALVLFFEANVFKNISFYQVTKIAILGGALALIVVLVLDKLFPVASLDLFGVLVTGIVEETSKVLVASYFVRKLNISHVFNGLLLGAAVGTGFAAFENIQFMITDSNQLVSMEAALFRTATSISDHTEWCAIATAALVLAKGNQPLRSATFWDYKFLRFFGLVILIHMCWDWSAFDTISILRYIILAIITWVTVFVMIHAGLREVKKLQQSLDVNEASVTAPDEKS

SEQ ID NO: 8602 - protein, 247 aa, Lactobacillus casei
MKTEGDVAIMFCPNCGAKVPEEADFCPNCGQPLNAKLKAQTAGYQKAEESAAPAETEKIVKPAKLQKSHRSVIIGVLIALVVVVCGYVFVYAPNMAKQAVLSNGFTGERGYSVQINALKRTVTIQVGSDQLSNISGAFMSGGFSTYPINQEKQMAKAANDLSGKVIGQWHIKEVTMKKDQKTPIDLWEFTGTKETMRYQDTDDFRAAKDAYDAKEKQAADEDQAQSNADSAIGGAIFGGILGWVLSR

SEQ ID NO: 8603 - protein, 347 aa, Lactobacillus casei
MKKKKLLTTAIILSSFSLFATGCYGIGNTTVTSSSKSSKMTPSESASKAAKRKSASKEASKAAASASSKALGDTATYGLPKGPSWLKVYSNGKDTDVHLDPNKVNTVKLQEYASFQLGGTLPWLGIVKSNEWQVGPNSREATLDEESSFKRGIAPAGANFNTGDTIGSLDFNDLKKADHKAISKQVFTDLPMLLDAISTNDKSKLPNQSSELLDSFRGQNSNNEIRTKYQLEEMYYNKEGADTTQNGKSNQMYLRVKKDGTNDIDKTTLGITIFAKVKTTDVNPDMPRVNGLTPSYGETQTEIDAFDLEYTLVDDNKWQLTHVDSSTQSHTALDTSQGSWIVQKVAS

SEQ ID NO: 8604 - protein, 395 aa, Lactobacillus casei
MVHLRKVGFWQTAALCLVGIVMVALTLTGCSTNASTTRNTSKTVSFVKEAKSSGTYIWIKTEADGAIGYRPAKSSIVNAIYVLSHGKLTAYQIQDNNITLGKLSKMNDADTIALAKAQDKKYFKVSADEVRNYMHKKDQIGQQNDFWITYVRQIVDGGGSIYYTCLGGEEDKTPIHDVKIVSEASFEKQRKEKENGQGKSDNSKEILSEDVKHLLITDEKSGNTYLTEKKMIGDSLINNIEKTKYRKPIEQRITRYKEKTDNSGNKIISQTFSFKNIDYFNADSFNERLYKAIPDKQALASLVTKRFNSDYFEKGQVTPEDVKKVFTPQVFEAATKGMFGYFPWTKALTLKLPISQQIYQTQYIGYILDNSGNSNVFDFLLTKSQVKGQKAVLSK

SEQ ID NO: 8605 - protein, 960 aa, Lactobacillus casei
MKKNAKITIVTTAAAAALATTGVGASQVHAATAEPETKTQGPVATVKTTTATKTPVEDAQANVNDATANETAAQKAQDDAQAKADAAAAAQKKAQQDVGNGQKAVDSAKANHDSAANTVSQASTDVQKAQTAVDAATPAAIDKAKDNINKATTDQAAAQTKVDTAKTTVASDQSNVSGATNTVNDAQAKADAAKAAVDKAQKTVDDAQKALDTAAAKKAVEEAQAKTDAANDSVKTAQTNADKAQTDKSQADSAVEAAQTALDNANKELTANKTVLDQANDAVKTAQNNASAAQTKVDAAQRALDAAQNTSNVNLAAEGITVSVNDAAKTAVQKYLAKTNTNSTDLTNMLDAVILGTTIDYKPTDADWNQILVDNKSNRWFGAVTNQEYDDVFKALSDAQREHFGDLYIAILNSIRTQLGLPSVVKSDVVSGETQEIGDVTSNDLDDGSMGFGLILVAYKNADGTVSWGTIESQTTRGIAPQKEYSMALLKDELINHGFLQRSVGSSDPNITVTPSSEADRTMQVLLGFSYKFISHRPLAYTVSFPAVHDTLGIKIDVAVLGNALDNDATINTSANVKNLETALNQAKASLTTAQTALASAKTSQAAKQAAYDQAAAAVTAAQTQLNNALKTQTQAATTVAAATKTLTAAKSTLADAQTQLAEAQKVYEASLQNRTAKLAALAKAQAALTNANKAASAANDVLAAAKAKLTTTQTQLAKDEAALKTAQDGLKKATDAVTAAKDALADLVNAPAKLAAAKQALADAQANLKTTQAAYDQAVASLAKCQDVLAEDKQATADAQALLKQTNTNLNNAKAQLATAKATLKSAQDAETLAEKVAREQHRLDAEKAAQTNGYHISGNTVVDQAGHLVNGWKVVNGKMVDSFGNVITTPAAGSKKVIQSQTNFTPAQPLVGSRMALRHGTTTMPQTGDDNETLLSAVGLAVVSIMGLFGLARRGRHA

SEQ ID NO: 8606 - protein, 533 aa, Lactobacillus casei
LLFPEAPGDFPMRLQPLIETNNVEALAKRKQNFFAANTKENSMTRLAAVLFAAGIHWPESDYRFSVAEEQILADRLTIPENLTPFEWELQSALIAPASHELLMLLWQRTERMKHNMRKFYRGTIGMKLWLGALMDRDFEFLNAIRDDLNLELKQYGQLHDYTDTQEVWHFTKLLEQWAQNPTPEHEQMLHKMIAATADAGASSQAKYFDLVFKRTLQGHPYHNERLVDHEVPIVVKKNPGEVIRSRRTYLGLKRSDIAHERDKSTLRRFETGQTQLSFGSLVRLCGQMAILPTTLLGSMHVTLQGAHRIVNLYNSWDNMTEIQENHLPASDGAKIIEKLKTASQDVAPHLLATQLFILQRAGMEAGMSGFDETSQRATARVCFHRMMKSNHWGMLEYMTLRYMVPLLSLDELTLMFRQVQRMLHKQPRFFGVSFAFEAMSIAFVRITQLAPKDENIQFLHAFNWLLSLDSSDAARWQAMGSLLTALDLLQPTKATQTALNQFLMRCKITGRVTVLAKLTKRWGDLVPKNYFER

SEQ ID NO: 8607 - protein, 306 aa, Lactobacillus casei
MHELKLFSLNGNRPLAEKIAEEVGLPLSPASVNHFADGEIQIELPESVRGADVYVIQSVSDPVNENFMELMIMVDALRRASAHHINVVISYYGYARADRKARSREPITAKLVANMLEMDGVDRIVAVELHADQIQGFFDIPVDHLKAHRLIGDYFKKLNLGDNVVVIAPDHSGTKQARALAEELHTPIAIVDKRDQDHIGVIGNVEGMHAIIIDDLIDTGDRIVDSYKALSEAGALDIYAAATHGVFSRGAVDRIKHLGLKKVVITDTIQLDPKHQFEGLAQVSVGPMLGKAIKLINSNQSIHVLF

SEQ ID NO: 8608 - protein, 309 aa, Lactobacillus casei
MKQSHLIGLATPLLLSAGTLATAERFYQYAFRRINYIPDARSSMQKYAPLYYSHVHWVESQRHIEAWHMTAPDNQRLEALWLPHPGSKKAVIIGHGYKGTGITMSNFAHMFYDLGFNVLLPDDRGHGESDGEYISFGWLDRLDYLGWLQRILDRLGNDAKLLLFGTSMGGATVSLVASEPSLPKQVKAVIEDCGYTDVETELAYLLKKQFHLPPMPLVPLASFINYRRLGYPLRVVNVRQALTHNHLPLFVIHGANDVYVPTEMGRQNYAASAGPKALWIVPGAAHAESYWVNPAAYQAHVKRFLDIFF

SEQ ID NO: 8609 - protein, 317 aa, Lactobacillus casei
MADEDAMLAKIQAVWAQTGARDKARYAEERVPENVHWETEYRYENSADPQQTLNLYYPAKRRNATLPTVIDVHGGGWFYGDRNLNQNYCRYLASQGYAVMGMGYRLLPDVDVRGQIQDIFSSLRWLSHYGPQRGFDLDHVLLTGDSAGGHLASLVACIQQSEELQELFGVSRVNFNFTMVALVCPVAEPSKLPEAAGDMSEMASFYLDKLSGGDQALADHLNFSQVVKGLDLPPFMLIGGQNDSFYLQSQALLQVFDANKVTYTTKLWPASAGPHLKHVFNVQHWEWPESIETNLAMLRAFDDLSKQHDEAEEDEFD

SEQ ID NO: 8610 - protein, 384 aa, Lactobacillus casei
MMEAVHFGAGNIGRGFIGETLAANGFKINFVDVNETIINALNQRGEYTITLAAPGEKKIHVDNVDGLNNAKDPEAVVKAIAQADLVTTAIGPKILPIIAPLIAQGLQARAAANNHEPLDVIACENMIGGSQALKKSVYEHLDDAGKTFADTYIGFPNAAVDRIVPQQKHDDPLAVSVEDFKEWVVDESQMKNKDLKLKTVDYVPDLEPYIERKLFSVNTGHATTAYTGKYLGYTTIGEAIKDPKVFNQAKGALAETRSLLLAEFKNFNEKDLETYQNRVLQRFQNPYISDDISRVARTPIRKLGYNERFIRPIRELKERGLDYSILMDTVGMMFHYVEPNDAEAVKLQAMLKDQPLVDVIKAVTGLKDAALIDEVEASVKSKDR

SEQ ID NO: 8611 - protein, 147 aa, Lactobacillus casei
MKGLDVNTIKLGQEAKTRDEAIRQAGQLLVDNGNVEPAYIDSMIDRNRDVSVYMGNFIAIPHGTEAGMKYIKKTGISVVQYPWGVDWSEDPADENLVTVVFGIAGLNGEHLKLLSQIALYCSDVENVQKLADAQTPEEIVNLLKEVE

SEQ ID NO: 8612 - protein, 693 aa, Lactobacillus casei
LRSSGAKNMLLTNREQKMIKLMMSQPAGVSRDELQRQLGVSRRTIYRELSQLEHDITALNLRLDKGDGSSYRLTGATTDLAKLSETLAQQQQDLTFDPSQRQSALILMMLNAGAPKTMTALATDVDVSVTTIKQDLDILEPALNEYHLKLNRQKAAGIWIEGQEGDIRRVLVGVLNAEINPYVFFRFLNDPRQTFDPVTDYFIKRLPQEELLAANTALSRIEALADLSDNQRKAVLLTVAVNTHRLREDHHAKAQPHFDQERLFQDQQLALQFLAEMDPTIREKVRVGDYQFLAVELSNIRGGLAGEQVDPFDLTINLEVQELIREVARKFPGKFSGNTQLYSSLLAHVQRTTGGDWLPGVTMTNPVLAHLRDDYPELYQAVQQAADDVFGRGAFTGNALGYLVLYFASVLDHTRTDAPVAVLLITSDGPGTGSLIAGKLRVQVPEIRKIKIIQVSDLPKQQLEHYDLVLATMPLPGFKHQYLVITPILGREEMAEIRRLVQKATPKQVRPANQPSLDQTVTAFESLKTMVMAADGLLQHFAVTDMTAPVTTIAAAIDAILSRLPTVVAEAPVVKEALLKRLELAPVGIPDTGLAMIHTSSQGVTTPYIGVFDLASSLPLPAMDMGTIQLQRILLLLTPNPVSQETLTLLSAVSAKLVASPADLRLFEKGNYSQLYQVMTEVFMHEIQKIDRR

SEQ ID NO: 8613 - protein, 619 aa, Lactobacillus casei
EIICBACMPNENTLEAKSANTPVTEKKKFNLKAGMQSFGTKLSGMVLPNIGAFIAWGLITAIFLKGGWYPNANLAKMITPMVTYLLPLLIAFSGGSMVAGHRGGVVGAIATMGVIVGTDVPMFIGAMIMGPLGGWCIKKWDNRFQEKIKQGFEMLVNNFSAGIIGMLLAIVGFFLMGPIISGLTNVMAAGVDWIIRHGLIWLANIFIEPAKILFLNNAINQGILTPLGIQAAAEHGKSILFLLEPDPGPGLGVLLAFALFGKGAAKGSAPSAIIIHFFGGIHEIYFPYVLMKPALFLSVMAGGVTGTTLFSIFNVGLKSSPSPGSIISLFLMSPKSLGNYLGLLIGVTGATVVSFLISAVILRRDKSTSGDELAESEAKMKSMKAEAKGQNVEAAKDVMNQAKGIKQIIFACDAGMGSSAMGASILRDKVKKAGLDLSVTNTAISNLQDKPGLLVVTQDELADRAKKQTPGAAHVAVENFLNSPKYDEIIASLKAEAVGGTNETATAEAPKAQQETPEDELNEIDFDKITEVDFLHHDQNIGSATMAQATFRSELRKLNKDVKVRNVAIGEIEDKDNVLIIASKETARRVKLQFANVQVYTVDGLLNATNYDKLIDKMK

SEQ ID NO: 8614 - protein, 236 aa, Lactobacillus casei
MDVKVFDNDTEAGKYAFELIKQGMDNGAKVLGLATGSTPVTMYQAMVNSDVDFSNMTSINLDEYVGMSPDNDQSYRYFMQSHLFDKKPFKETFVPNGLAKDPEEETKRYNKVIADHPIDIQVLGIGRNGHIGFNEPGSPFDAETRKVPLTQNTIDANARFFENKDDVPRYAYSMGIGSIMKSKKILLLAFGENKADAVQKMIEGPVTNDVPASILQKHPNVVVILDKAAASKLSKK

SEQ ID NO: 8615 - protein, 261 aa, Lactobacillus casei
MYKAVVFFDLDQTLLNDEKQVPPENVKALKALEANDVLPVIATGRSYYELADIMAATGIRSAITANGGDVFLNGEHIFQSVIGEPQLVRFLNATAAQDIQVAMYSSEASALTGYDQLTTDNYAQVHQTPPPINPKYYQEASLSLLLIFLPWNQTGDQLGKQFIQDFPELTFYRNSHFSFDVVNHGISKGSGMSVLLNQPALRGVPTYAFGDGYNDIPLLQAANTGIAMGNAYPKVAAIADYQTDDYRKNGIPNALAHFNLI

SEQ ID NO: 8616 - protein, 86 aa, Lactobacillus casei
MLEQSTMHPVVWINKHTYISIVKNADYNLEVWEITAENRQHRMARMNYKYHRDNFAGFIYRLFPQIDLIQIHNIQKKINPYFDLEV

SEQ ID NO: 8617 - protein, 58 aa, Lactobacillus casei
MDSLVVQLLIMVVVAFIITLAVIVAEWRTKTFKTWQISVQSVVAILLLAIGISLLTVR

SEQ ID NO: 8618 - protein, 255 aa, Lactobacillus casei
MDDFKLPTLMAQRLVDGLMGGYKEYLAERKQKQQALTISGAFAWTRSNFIDSKISELFSQDDTVDSQIDKAGYAWEYLQFIQENDNDRALIIVKNARQVKRNFNGATASIDKNNYLYRLAGINNTWSAAGLLSGKPTDRVVQLELALPEATTDFEHLAEQVSSKFSKFYIVTYEVDNVSKMISDIELTMPNQSKMTLSPIQNLTPLISRSQFQINSEELETIQGDQVPDAAYEQNTLFGYEINTDAENEREAGAE

SEQ ID NO: 8619 - protein, 390 aa, Lactobacillus casei
MFIGSKLKALRELNGYTRKDLSVQIGVTEQAVWQYETENVMPKIEILNALQQIFNVDMAFLVNGNAPKHVVHEAKIAFRTTDRSSRKKTKLEARYLDFADGLTSYFEKFVSVRPAGFDKLQQMVQTKLSGTNNLTKIREVAKIARQFLGLQDNHDLMAKLEQVGIYIVEKDLGVHIDAYSTITDNGHAWIVLGSIKKSAVRRNFDLAHELGHLLLHGAIDFDELTAAEYKQIEHEAHTFAAEFLLPIEDFTADFKKLYRRSNPDYYLDLKRKYLVSIVAMAMHAYALGLMSYQEQRYFFGQRSKKGYKIMEPLDDQLVPVRPGKIRALITLLFNQQVLTLRDLSRHLHVRPTFIAQLFALEPDFFTKYQPQHSYANMQNVIPFPRRFTKN

SEQ ID NO: 8620 - protein, 111 aa, Lactobacillus casei
MPKHLRQFLLTYNADLRMRPLTYCFLNTCLFALYFIAFMSILISYEALWSISIVIFICLLNFLINIISVVSHANNAALSSLFKTRRRWLIQFIGTALVSVALFSLGLLTKL

SEQ ID NO: 8621 - protein, 355 aa, Lactobacillus casei
LKKRQAKHKGISQRMVIIGIGILAIIVVTIVFFMTQHKQPQQSTTSNAVATFQVKRHELRLSGQAQATRTQKIEVPEGTVQNQSVKNGDTVTAGQQLLTVYHPDVQEKITTANQSLQKQQRSLKQLDDKINQLKSSLNQLAADDPQRSDLQSQLDEAQSSRQDSAAAVDEANQDVAKLQQNLNTVVKAPFAGRLFIDYQANGQQSITETSSEMEAVGQVSEFDYADVKVDQSVTVQALSTKTKQTTSINFISSDPAKSSKPNLAKYDVTAKLDHGFLNGQSVSMIIPLSGLQIPKTAVRQGAVYKVVNGRAVRTKITYTKKDDMYEVTDGLSSGDRILENPTKSTKDGAKVTVDD

SEQ ID NO: 8622 - protein, 229 aa, Lactobacillus casei
MIDLQHVNKSYGQGATAFHVLKDINLHIDEGEFVAIMGPSGSGKSTLINIIGFLDTAFEGKYFFQDENVADFNATKASRMRNRHVGFVFQNFSLIHNLNIFENVLIPLSYGGHRRSEVRGKISELLESVGLTGMENKLPRNLSGGQQQRVAIARALANSPQFLIADEPTGALDSHTSADIMQLFKELHRKGGTIIMVTHDEHVAEQSDRMIKILDGQIISDTEVAHATK

SEQ ID NO: 8623 - protein, 397 aa, Lactobacillus casei
MRLSELIRISFRALAANKRRSFLTMIGIVIGIASVVTILSLGNGIKAATVKNLQANTQGQQTAEITFNPTSSSETDAGFKESDITLAKQTAPDKIKKVVIKHDEENLQVNGQLANADTMMSVTLVNKAKPNIQLNAGHGFSQESLQTDGEDALISKKLAKKVFHGNTAALNSSLELGTKNYNIIGVFSPPKTPYSALDVDVLVPEKAYRAGQLSQEGRKLAITYKTGSDVSKLTNNVVRQLKKSGSERRSGEYSYFDYGELLKGIGNVISALTLFVSAIAGISLLIAGVGVMNMMYISASERSQEIGIRMAVGATPAEIMKQFLLESVMLTLTGGVVGLIVGALTAWIIAMFLPFKPVVTLGSIIGTFAISSIVGIVFGLLPAKSAANKNLIDILKS

SEQ ID NO: 8624 - protein, 389 aa, Lactobacillus casei
VIFSESAVLQALPKQFFASLVKHVNARIAAGHDVINLGQGNPDQPTPANIVQVAQQAVAKPGNHKYSLFRGLPSFKQAAAEFYEREYGVQLDPEKEIAVLGGSKIGLVELPLALMNPGETILLPDPGYPDYLSGVTLARVKLALMTLTADHDWLPDYAAIDPAVADAAKLLYLNYPNNPTTAVATPAFYDQTVAFAKAHHIGIVSDFAYGALGFDGQRPVSFLQSAGAKDVGIELYTLSKTYNMAGWRLAFAAGNADMIEAINLIQDHLFVSVFPAIQEAGIEALLGDQTSVPELIDLYQQRRDAWFSATEAIGWHGKKSPGTFYAWMPVPAGYTSESFTELLLERADVAVAAGNGFGDHGEGYVRIGLLTSPQRLEEAAQRIGKLGLF

SEQ ID NO: 8625 - protein, 260 aa, Lactobacillus casei
MTQLTLALAQIDIAFGQPEQNYQKVADSVAEAARKKADVVVLPEMWNTGYDLEHLETLADPDGLRTQTFLSDLARHYHLTIVGGSVATAENEHFFNRSLTLDAQSHLLASYAKAHLFRLMNEEKFITAGSEANHFTLAVPASVAICYDLRFPEWFRRMASDGTQLFFLPAEWPMPRLPQFAALLTARAIENQAFVVAVNRVGQDPGNDFGGQSQVIDPFGKRLLQLDDQPQVGIVTIDLAQIAAARQQIPVFTDRRPELY

SEQ ID NO: 8626 - protein, 279 aa, Lactobacillus casei
MKKWLKLSWAAVLALSLLVVLTACGSSSASSKTSANQLSDKTITVGVTAGPHELIMKQVAKLAKKDGLTIKLKQFTDYNSPNVALNDGDLGANSYQTLPFLKEQIKSKNFKITQVFKTVAFPMGVYSKKIKDLKALKKGDSIAVPNDPSNELRALQLFEAAGVIKLKAGISQKATKADVVENPLGLKIEELEASQLPTHLQDVTAAAINTNFAFDSGLTINQDAIYHEKTKNNPYPNYFVVQTKHQNDKVIKQIKKYYQSKTIKDYIAKEFKGSIVPAF

SEQ ID NO: 8627 - protein, 361 aa, Lactobacillus casei
MELEFDLRPGANRFVSEAGALAYLDTILKDFTKPVVITGEKSFAAFEKAYPGTLDLPVYHYDGSASDENGHALAEAIGQADAVVGIGAGRLIDTAKVAAETLGAELISIPTLASNCAPFTPLAAIYHAQGHTFSYVEYFKKSAYITLVDYNLLLSTPHDFFVAGIGDTLAKWYEMDGITRNKIDQLNAYGQLSRASAKTIQAILFKNAEQALADLDAGRDTPAFEAVADTIIGLAGEVGGLGGVDGRAAGAHAVHNGLSYLPETHAILHGSKVAYGILVQLATTGDDDEIRSLMPFYEKIGLPLNLEDLHVTKNVSQKMQQVAEFAAQPEETFILIDKDLTPQQIVSAMKKVEQVTSEAAA

SEQ ID NO: 8628 - protein, 162 aa, Lactobacillus casei
VRLLVEFIISILSSIGFGVITNIPKRALLPAGITGGVSWCAYWLISLQDHSLVLPNFTATVIIGLLGNYFAIRHRVPVNTIYIPSLVSLVPGGIAYLGARSFTMGKAASAAQQIYNVILIAMALAVGFVVAEVIFKAIRPFLIRLIAKLPEAQTKSRGGKSA

SEQ ID NO: 8629 - protein, 254 aa, Lactobacillus casei
MSQPDTEEILEVCGKVGEILLNAGAETSRIETTVEYIGHAAGARVACYATITAVFVSLENESRTRLIKSSLGGFNLQKVDELNQLSREFVAHKITFDALKRDVARIDRQVINFPWWARILGAGWVSVAPMLLFKATNGDLAWAFFVGIFGYLGAEFVGRRTTTPYFKEATGAFVVAILAELLMNIGWGDNAGNIIISALMPLVPGVAITNAIREILSRQIISGIVRTVDAIFVAGAIGSGVVIAIVLTQVLGGR

SEQ ID NO: 8630 - protein, 68 aa, Lactobacillus casei
MDILWPRLLLILLLSLIFVMLALSLIAILWKSKFSVLLKSLLATLIGGAMILLVYGSLFIIFFGVNTP

SEQ ID NO: 8631 - protein, 73 aa, Lactobacillus casei
MKQNLIQSLWFIFLLFLAFVVPVFGILPAIYLWTTMKKVPDLAAMRGWTMGALVVQGCYLLALVLIFLFFVPA

SEQ ID NO: 8632 - protein, 633 aa, Lactobacillus casei
MPEVKKFEAGKYDVVVVGAGHAGCEAALAAARMGQKTLLLTISLEMLAFMPCNPSLGGPAKGIVVREIDALGGEMGKNIDRTYIQMRMLNTGKGPAVRALRAQADKAAYHRSMKHVIEDTPNLDLRQGLATEVLVEAGKAVGIVAATGAIYRAKSVVLTAGTSSRGKIIIGELMYSSGPNNSLPSIKLSENLEHLGFKLRRFKTGTPPRVNGNTIDFSKTEEQPGDTTPNHFSFTTPDSVYLKDQLSCWMTYTNATTHQIIRENLDRAPMFSGVIKGVGPRYCPSIEDKIVRFADKPRHQLFLEPEGRDTSEYYVGDFSTSMPEEIQLKMLHSVAGLEKAELMRPGYAIEYDVIEPWQLKVTLETKIVENLYTAGQMNGTSGYEEAAGQGIVAGINAARRAQGKGPFTLKRSDAYIGVMIDDLVTKGTNEPYRLLTSRAEYRLLLRHDNADLRLTPMGHELGLISDKRYADFLAKRQAITTELKRLETTRLKPKDVNPWLEAHHFAPLKDGVLASDFLKRPEIDYQTMAQFLPDNPELDHRVIEQVEIQIKYAGYIAKEEASVAKLKRLEGKKIPTRIDYDAINGLATEARQKLVKIQPATIAQASRISGVNPADVAILSVYIEQGRISKVAQ

SEQ ID NO: 8633 - protein, 462 aa, Lactobacillus casei
MSTSITAYDTIAAISTPPGEGAISIVRLSGETAVTTANKVFKGKDLTQVKSHTIHYGHIVDPETGDLIDEVMVSVMLAPKTFTREDVVEINCHGGIVATNRILQLLLGEGARMAEPGEFTKRAFLNGRIDLTEAESVMDLIRAKTDRAMQVAVNQLDGNLHTLIKRLRQEILEVLAQVEVNIDYPEYDTDEMTTKMLLEKAQTVKKAIEQLLTTASQGKVLREGLATAIVGRPNVGKSSLLNHMLHEDKAIVTDVAGTTRDVLEEYVNVRGVPLKLVDTAGIHDTTDKVEKIGVERSRQAITQADLILLVLDQSQPLTAEDRELIAATADKKRMIVLNKQDLPKQLDTDALYQLVKPNEVIKTAIPTSDGMDELDERIAKLFFGGIENSQGTVMVSNARQIGLLRQASKSLDAVIAGIDAGMPIDLVQIDMTAAWDKLGEITGESAPDELITQLFSQFCLGK

SEQ ID NO: 8634 - protein, 255 aa, Lactobacillus casei
MPTFQGSTIQKAIETGLKQLGLPRDAVSVQVVQENKNGFLGFMRKPAIVNLKPLEPPADPAPDPKADHDPAGKSRPGKLAVALTDTAGKKIASAFNDITTKKRDNQTALAMVQSYLEDITTGMGIKTQVTSERQGNTVNFQLKTDEEGLLIGKHGKIINAIQYLAQTEFNHYAKSKWTIMLDVGDYRERRQATVTRLAERTAREVLATGKAIYLDPMPSFERKAIHTTLADNQYVDTHSEGVDPRRYVVVTPKRP

SEQ ID NO: 8635 - protein, 287 aa, Lactobacillus casei
MLRLREGLFVKNRQIKRLLVIVSMLSLVFILTACGTAPVSEHSTGFWDRYVVYTAGQFVIWLANLFGGNPGVGIIAFTLIIRILIFPLSYLSIKSMAKQQELAPQMKELQQKYSSKDTETQTKLRDETQKLYASAGVNPVMGCLPIVIQMPFLIALYQAILRTTSLQSGTFLWMNLSKPDPWWVMQILATLFTLGTSILSMMAQPTRNSSSWIMMIISPLMIFVFSVTLPSALAIYWVVTNAFSMVQQLLIQNPFKIRREREEKARAEKEKERALKKAYKKATKRRK

SEQ ID NO: 8636 - protein, 118 aa, Lactobacillus casei
LRKSYRIKKEAEFQNVFDHGDSVANRNFVIYHMKRDQPHFRVGISVGKKVGHTAVMRNQIKRYIRQSLLELKPDIDPQTDFLVIARKSANQLDMAETKKNLIHVMRLAGILNEDIEVI

SEQ ID NO: 8637 - protein, 46 aa, Lactobacillus casei; identical to SEQ ID NO: 2951

SEQ ID NO: 8638 - protein, 449 aa, Lactobacillus casei
MPNLEELWAYLNDKFREELTPVGYSTWIQTAKPVKLTKDKLEIEVPASLHKAYWEKNLVTKVVEGVYEFAQLEVDPVIMTKDELQPVTTHQQPTTADDDDQQLTFKAKTHLNPKYTFDRFVIGKGNQMAHAAALAVAEAPGTTYNPLFIYGGVGLGKTHLMQAIGNLVLENNPAANIKYVTSENFANDFINSIQTKQQEQFRQEYRNVDLLLVDDIQFFGDKEATQEEFFHTFNTLYENMKQIVLTSDRLPNEIPKLQERLVSRFNKGLSVDVTPPDLETRIAILRNKADAEDLSIPDDTLSYIAGQIESNVRDLEGALVRVQAFSTMKNEDITTSLAADALKALKLDDRSGQLTIAQILDAVAKYFQVTVQDLKGKKRVKQIVIPRQIAMYLAREMTDNSLPKIGQEIGGKDHTTVIHAHEKIMSTMTTNEDLKAQVVELRNILKNRG

SEQ ID NO: 8639 - protein, 379 aa, Lactobacillus casei
MKFTITRSTFLKTLNDVARAISTKTTIPILTGLKIVLTDTGLVLTGSDADISIESRINIADENNDLQIDSTGEIVLPARFFSEIVKRLPEDKMTLEVKDNFQTVITSGASEFTINGLDANNYPRLPEITADEALTVPAEVLRQLINQTVIAVSNQESRPILTGVHFTIMGDQLVAVATDSHRLAQRTLTLPSASTTNYDIIIPGKSLTELSRMLSEDVEKIEIRIAENQVLFVFGQTAFYSRLLEGNYPDTSRLIPTSSNTQVEFDAPVLLASIQRASLLSHASSNNVVRLMLNIADQKATIYGNSPDVGNVEEVLTFNKLTGEDLEISFNPDYMKDALQGFGQTAIEVDFTAPLRPFTLVPTEDKEKFIQLITPVRTF

SEQ ID NO: 8640 - protein, 70 aa, Lactobacillus casei
MTTIKITTAFLTLGQFLKEAGLIDSGGAAKWYLGENPVTVNGEAEDRRGRKLYPDDQIEVAGQTYVIVSA

SEQ ID NO: 8641 - protein, 372 aa, Lactobacillus casei
MKLDHLTLKNYRNYATVDTAFSPEINVLIGENAQGKTNLLEAIYVLALARSHRTNSDKDLIRFGGDFARVSGRISRQSGTHQLELVISHQGKRARIDRIEQSKLSQYLGHFNVILFAPEDLAIVKGSPAGRRRFIDMEFGQMSSKYLYNLSQYKTFLKQRNAYLKQLKYHQAKDLVYLDVLTDSLAAFGAELITARAKLLQTMSGYAAAIQQDITKGRETLRFSYQTQVDAEAQQNSEAAYAALGALFAKQQAREIEQGTSLVGPHRDDVAFIVNDKNVADFGSQGQQRTTALAVKLAEIDLMKDQTGEYPVLLLDDVLSELDAMRQTHLLKAIQSKVQTFLTTTSLDGIQKEIITAPAIFRVQDGVLSKQA

SEQ ID NO: 8642 - protein, 653 aa, Lactobacillus casei
VTDKKESAEEKKEELAAEYDASQIQVLSGLEAVRKRPGMYIGSTSSQGLHHLVWEIIDNGIDEALAGFATQIEVEVNPDNSVTVTDNGRGIPVDIQAKTGRPALETVYTILHAGGKFGGGGYKVSGGLHGVGASVVNALSTNLDVTVSRGGKRYYIDFVRGKVNTPMKVIGTAPEHEHGTKVHFLPDPDIFTETTTFDDKVLTTRIRELAFLNKGLKLTFTDKRAATHEKLVFHYEGGLKSYVDFLTEKKENLLQEPIYVEGQDKGITVEVALQYTNDYHSTLLTFANNIHTYEGGTHETGFKTALTRVINDYARRSGALKDSDDPLSGDDVREGLTAVVSVKHPDPQFEGQTKTKLGNSDARTVVDRTFSDHFNKFLMEHPADGKLIIDKAMLASKARLAAKRAREVTRKKSGLEISNLPGKLADNTSKDPEISELFIVEGDSAGGSAKSGRSRLTQAILPIRGKILNVEKASMERILANEEIRTLFTAMGTGFGQDFDISKARYHKLIIMTDADVDGAHIRTLLLTLIYRYMRPVLDAGYVYIAQPPLYRLRQGKMMRYIDSDEELQDILGQLPPSPKPDIQRYKGLGEMDASQLWETTMDPDTRRLLRVSPKDAEEADGIFEMLMGDHVEPRRKFIEENAVFVDPNNIDV

SEQ ID NO: 8643 - protein, 876 aa, Lactobacillus casei
MDDRQESRITNVNLGETMRKSFLEYAMSVIVARALPDVRDGLKPVQRRILYGMNELGVTPDKPYKKSARIVGDVMGKYHPHGDSSIYEGLVRMAQDFSYRYMLVDGHGNFGSVDGDGAAAMRYTEARMSKIAVEMLRDINKDTIDFQDNYDGTEKEPVVLPARFPNLLVNGATGIAVGMTTNIPPHNLSETISALHVLMDNPDATTADLMQALPGPDFPTGGVVMGKSGIRHAYETGRGTIVLRGKVDVQTEKSGRERIVITEIPYMVNKAKMVERIADLVHEKKIDGIVTLRDESDRDGMRIVIDVRRDASASVILNNLYKLTPLQTGFSFNMVAIVNGAPKLLSLKQILQYYLDHQENVIRRRTQYELKKAKAREHILEGLRIALDHIDEIITIIRSSETGDKAKVILMDKFNLSDKQSQAILDMRLVRLTGLERDKVENEYKDVEAAIADYTDILAKPERVHQIIYDELLDIQKKFGDKRRTELLVGEVLSLEDEDLIEQEDVVITLSHNGYVKRLATSEFKAQNRGGRGIQGMNVHDDDFVERLISTSTHDVLLFFTNKGKVYRSKGYEIPEYSRTAKGIPIINLLGVGAGEKIQTVINVHEGQKDDRYLFFVTQKGVVKRTPVKEFANIRSNGLIALNLKDHDELNNVILTSGQDNILIGTHLGYSVAFKEQDVRSMGRSATGVRGIRLRDHDYVVGSDILKPDSEVFVISEKGYGKRTAAKEYPIKGRGGKGIKTANITEKNGPLAGVTTVNGTEDILVMTDSGVMIRFNIQSVSQTGRATLGVRLIRVDDDAKVATMAKVEPETDDPEDGNKPDQPTDPQAGPTDPDSKQQPADGQYAGNADEQVNKLLDRAETDQPASDANDEDEDED

SEQ ID NO: 8644 - protein, 143 aa, Lactobacillus casei
MLNCVSLTGRLTKEPEVFKTAADLELVRFTLAVDRVFKNKTGQRETDFIECVIFGKRALTFASSTTKGSLIGVAGRISNNHFENKQGEQRWRTSVVVDNFAWLESRAMTESRRTGTLQATGTDGMPAGDPSASPELATDDLPF

SEQ ID NO: 8645 - protein, 98 aa, Lactobacillus casei
MAETKYEVTYIIRPDLDDAAKTDLVERFDNILKENGASIIDSKDWQKRKLAYEINKYNEGLYHIVNLSAEDDKAINEFDRLAKINNDILRHMIVKRED

SEQ ID NO: 8646 - protein, 197 aa, Lactobacillus casei
MLNSVALTGRLTRDVDLRYTQSGTAVGSFTLAVDRQFRSANGERETDFINCVIWRKSAENFANFTKKGSLVGIEGHIQTRSYDNAQGQKVYVTEVVVENFALLESRATTQQRPSESANPAGQGNQNYGGGQQFGNNQQPQNPPSFGSQSAPNNAPSSNPGQNPAAGQSQGNNGNAANPDPFANNGKPIDISDDDLPF

SEQ ID NO: 8647 - protein, 78 aa, Lactobacillus casei; identical to SEQ ID NO: 2963

SEQ ID NO: 8648 - protein, 168 aa, Lactobacillus casei
MAKIAVLVTDNFEDAELTSPVKALKDQGHDVTLIETQAGKQITGKHGATATIDTTITDVKPDDFDGLLLPGGFSPDELRADDRFVNFVKAFLLADKPVFAICHGPQFFIQTGLTKGRTMTAYTTVRPDLYYAGAIVKNEPVVVDHNLVTSRTPDDLPEFNKAMLAQLK

SEQ ID NO: 8649 - protein, 492 aa, Lactobacillus casei
MGLTLAAIPLAVTNLSRMQFAVTAITHFLFVTTTIGMLLTTMIFEFLYAYGRGDTEKYGRLTLFFSRIFFFSFGTGVVTGLIMEFQFGMNWSAFTRLMGDVSGVPLAIESMISFFIESTIIGLWRFTWGKLPKRAHAWLGVGMLGASLFSVVWIIAINAFMQNPYGFHLENGRARLDSLITLLQNPQYRPEFLHVLFAILITGGFVTAGISAWQILHKRDTAAFKIAVQIGLLIALPAAFLQPAQGDDQGAATAALQPMKFTAIEGRYDLEGSATTGAPWAMAALINEKDHTTKAISIPNMGTYFGKNTFTGAMPGMNQVAKMYHAKFDKTVAKSYDGQMNYYPPVTLLFWTMHLMVYAGYFFTMFALFATIMLHRRESTIEEHPKTLRTLGWTLWLPYLTFTSGWIVAEVGRYPFVVYGLLTQYDAVSPSLTATEAGTSLALFFIADVFLVSTMIYISHRTVTRGLPQITGDYPEDRTIPDPFAKEAFSHA

SEQ ID NO: 8650 - protein, 339 aa, Lactobacillus casei
MPSLSNLQVIFLGIISTELMLFFVLDGADFGAGMATFFVGDDLSRRQQIMKVTGPVWGGNETWAVTAFAVMFAAYPGWYSALTSGYYPLIFLMLFFLIFRGVAFDYRNQWHSRHYNQFWDWALFIGSLMPPFLLGIVFSSTVSGVPIRNGFVYASMGDILTPFSILGGILAVLLSLNVGLTRVIKKVSANVAEQLTVALKRTTWALYAAVVLFAVLLPFYTRFFTNRPVIVSLLLILLVAFLGVETWSIANHHPRVTFWLSVGTMASFIYTIFLGVFPTLIVGRARGTSVTALTATSGPVSLLWTAWLFGFTIILMVGLQATAYHLINKYYNAPASPMI

SEQ ID NO: 8651 - protein, 64 aa, Lactobacillus casei
MKKIWINIFWGLLVVGFWLYQVFWPVFWNPISKFYGNVALYTIALIALGFAIRATLKGYGRQKA

SEQ ID NO: 8652 - protein, 72 aa, Lactobacillus casei
MNNLDILSTNELQSIVGGDAGKCLAGTVGGGVGGILTGAGLGAKTKNVYVIGGLGILGGIGGAIAGASQTCF

SEQ ID NO: 8653 - protein, 71 aa, Lactobacillus casei
MNEIRKLSELEMQKIVGGRDVGKCFLGLVGGGTIGGLNGASALSGFGPAGITLGGLYGTLGGILSGYSVGC

SEQ ID NO: 8654 - protein, 69 aa, Lactobacillus casei
MFKETIVPLSDAEISKITGGGGGKYYGNGVYCTKKKCYVNWGEAINSIGNNMAANWFTGGQAGWNSGIK

SEQ ID NO: 8655 - protein, 67 aa, Lactobacillus casei
MNTTNAIHAMKLDASTLEKIKGGTNEDFLNAAQASEKSNLVRVPPIERPKHGKRYPIPIVKPILQDI

SEQ ID NO: 8656 - protein, 72 aa, Lactobacillus casei
MYKAKLNNLGNAEVLANNELQVTIGGGSRVPVTGGGGAGFTFKISDLPGPKGPTYHSGPRKSRRAGRHYAIN

SEQ ID NO: 8657 - protein, 228 aa, Lactobacillus casei
MLLKLKKANLLAIFFAAKGILFICCMLLFFYWLFLILTNTFLIPSSNFVGNIPSILRGELWYIVTGSIYHAELNHLLINILPIIILGPFIEWKIGSMALVTSFFVSSWIATLLFCFVFGGYIQTSFGIGLYIYTFNGASLSVYALFPLVVLAFFIKKPAFSLISKIILFGFFWYFIFGLIPNVSASDVEILTQIAHLCGVLAGLLCTFIILILRNWKKIPFLRPKTIS

SEQ ID NO: 8658 - protein, 84 aa, Lactobacillus casei
MVNIKYGFASRYNRYYSPQIDERDCGVAALNMILRYNKSDYSLTRLRQLAKTDQEGTTALGIVRAAESLDFETSPIKTDMSLFN

SEQ ID NO: 8659 - protein, 357 aa, Lactobacillus casei
MFALVCFLIMLPMIFSVPLLYVGMLPRSRQQPALLTMSVALMMAIGCWLVFGNYLAFGTNLLQVNRFADLLGGLVQMDFYLYAIAMLIGTVVGFKHSRYLVIFVPVWTALVYCPLAHWLWSDGGWLQRLGALDFSGGIVVHLTAGLTSLVLAKSLTRSREAVVANDFRTDYAATIMILVGWLGFNLAPVGGLNAQALQVLIKTLITVLAAIAGWCWLTYWRTQSVSLGDLLNGILCGLVTSTALVGYVGAGTMSVVAVVSGGLCQTAVVKMQHAKRFYDAVDSFAINAVGGLTGVIGLMVARLVTRQDGVRFAGVELLAVLVTVGLTVVGTFLAQAAAHVSETGLNRLTVRDSKRLD

SEQ ID NO: 8660 - protein, 85 aa, Lactobacillus casei
MNQITIIGGGAAGIGVGVILKQLGCQQFQILEQGEIGESFRNWPKETRFITPSFTSNGFGMPDLNAVTMETSPAYTLGTEHLSGP

SEQ ID NO: 8661 - protein, 288 aa, Lactobacillus casei
NADPREDCTASEVAETYTLPIAEHTRVGAITANADSYTIETDHGVVESKYLIMAVGQFAFPKLTDHPENVIHYQQVHSWQDLPGETQIVIGGNESGVDAAINLATLGHKVLMITESTGLNAASPDPSIRLAPYTRRRFLDLPPAVADRITLQQNATLKTVTSDSPSQYQLWFTDGRTITTPYKPILCTGFNPGPLKLWPELFESADGEIKLSDVDESTRAKNVFVVGPDVRHQDAIFCYIYKFRQRFGVIVNEIAAREKWDIGDFVTVSRANSFYLDDCDTCDVACDC

SEQ ID NO: 8662 - protein, 418 aa, Lactobacillus casei
MKFNKAMITLVAAVTLAGTASAVTPVFADTSASIASNKSETNELLKQIEAANTEVINLNKQIDDKNSQISDATAKISATDAQIKSLSGQITAAQKNVTARKNNLKDQLISLQKKAGSSVSGNVYIDFVLNSQSLSDLIARTMTVGKLSQASKEALDAVTVAKDKLAALKNQQETARQTLVSTKSSLETQKSQLVTLQKTASDKQDALNKQINDHRDELVALQSQFAQEQEKTAAATQAALKTVAASTGSASSKSADSSSSTTKAASSQSTLSTTSTSSNSGATSSVISNNTNSGSGSHADYSSSANTYPWGQCTWYVKSVASWAGNGWGNGAEWGASAAAAGFTVNHTPAAGSIIVFAAGQSVGGQWTADGQYGHVAYVQSVSGDSVTISQGGMGFSSPTGPNTQTISGASSYTYIHQ

SEQ ID NO: 8663 - protein, 860 aa, Lactobacillus casei
VISLKPLTKNLWRNIRDSLGRFIAIVIIIMLGVLLFVGVKATGPALKDSLNTTVKADHLADSQLLATTGVTKAQVKAAQSVSGTQAEAVKFKYAIGGKASDVVALYGYQKTATINRLHLTSGHLPTHHNEIVLDSVAKKSGYKLGQHYTFARNSGLNRRTYTITGFADSPAYIEDTSRGSANIGDGTVRYFAYIPDQQMNMPVASQLNIRFPGLQKRDTFSSSYKDAVAAKMKQVKRRVKDQAQKDLQTMIEAKIVQAATKKATAQATAAGMPASAAATTAQAAVQKQQATLKKQASTRAQKQLTTSLTWQTRSDLPGFGDYGGSADRIAAIANVFPVFFFLVAALITFTTVSRMVEEARAQIGTFKALGYGKWAIARNYLAYAALAGLFGGVIGVFAGNLSIPRIVLSLYKNYIPLKQVVTLQWPLIALSIVLALIATLGAAIIVVRNELTEKPAALMRPRAPKSAKRILLERITPLWSRLSFNQKVSYRNLFRYKSRLIMTILGIAGGTALILTGFGIKDSITATGTLQYNDVVHYQAIARLADGKTPTAARTVLKKSNAYRSAGTVSSAVAKLSVNGHQISDVNLFAPSSGSSLEPYVSLRSTKTNQKLTLPRSGIVITSKVAKSLKVGTGDRLKITTTDGKKHSFKIKGIAKNYVGHFAYLSNTSYRQLAGQHTDPNALLVRLRPQTTKQNDRLAKRLLNHHAIIGISFTTTAKKTLSNMSGMLDPIVLIFILLSAVLSFVVLYNLNNINVSERIRELSTIKVLGFFDREVTMYISRESIVQTIVGILFGYGLGNLLTAYILQQAETADVVFPLTISFTGYLTATLLMIGFTAIVTWLTHRRLQRVDMVEALKSNE

SEQ ID NO: 8664 - protein, 233 aa, Lactobacillus casei
LAYIEVKHESKRYKMGETTITANQDINFTADQGKLTVILGPSGAGKSTLLNILGGMDSPTEGEVWIDGTDIATFSDKQLTAFRRHNVGFVFQFYNLIPNLTTKENVELAGSIVKDALDPTTVLQQVGLGARLDNFPSQLSGGEQQRVAIARALAKNPKLLLCDEPTGALDYKTGKQVLQLLQDASRKDHKTVLIITHNAAIAKMADRVIEINDAQVRSIHDEAAPTPVADIEW

SEQ ID NO: 8665 - protein, 183 aa, Lactobacillus casei
MSGTRDNRRVQYTVSRFKTALLQILETKALDDVTVTEICRQADLNRGTFYLHFQSPLALFEQIETDLLNEIQPYLSVKIDDMTRMLVPILKVIMQHPQAATILLTTPDSSVLQKIVRPIQAQTQSRYQTWYGETDKDHLDYYYTFFINGAVGVLTMWLKHGMQEPPEQIAKVIENVVTKGAPH

SEQ ID NO: 8666 - protein, 268 aa, Lactobacillus casei
MRNVKLIASDMDQTLLTSKGVLPPHFDRYLHRLHQAGIEFVAASGRPLYTLQETFPHFSQHISLVCDNGGLVATHGHIIGKSLISAAKYREIVSFILEKTDGVPVLCALDAAYINAVDAKYAPALLPFYHKLKKVPNLLDMSLEVDKVTIYFPNADSRKNADRYFRPVFGQDYTVQVSGETWLDIQNLGVNKGRGMRILSRHFDIPTAQMMAFGDYDNDIPMLETVGYSYIMANATQGMAQHAKYRTRSNDEYGVLHVMDQVLQAQEG

SEQ ID NO: 8667 - protein, 101 aa, Lactobacillus casei
MRVVIGGYGFVMLLVAWQAWQAKQGNPLFNQLTALAAVLVLTAAVIPDKVNAVIVLLIGLLGLSAVAWLNGIAMYGKPHVSHHLVRLLVHLVLFGLAVWLL

SEQ ID NO: 8668 - protein, 257 aa, Lactobacillus casei
MTLAIFAFLLIAGIGAGLTATLAGLASLVSYPALLAIGVPPVIANVTNTAALVFTGVGSAVSSLPELHGRGKFLWRLILLVSLGSIFGSALLLIAPASTFEKIVPFFIIAAGLLLLFSGKLPTQEHDPNEPARRLTFRQEALQTIVIFVTGAYAGYFGAAAGVVMLATLTLTVDQPFIVSNSMKNLTGFAANGIATVIYAFTTKIEWLMVIPLGIGLFIGGYIGPIIARRLPVQLLRVIIAVLAFLLAAKLFAQAYF

SEQ ID NO: 8669 - protein, 212 aa, Lactobacillus casei
MANSTDDMLHQAQLFNDFTAKQKLIIIAAIDVFAEKGYAATSTKEIAARAGVAEGNIYSRFTNKRGLLNAIITPVLDQMFPAELDDFIKSRLNQDYVSLETFLTVLIKDRITFLQANAQIIKIVLSELLNDTQVREQVIGNFTAQYWQTMTHDLTVLKQRGVLVDWPFEDILRAIWSTTSGLILGFLYFNQPLDADTVNHSITATIKALTPK

SEQ ID NO: 8670 - protein, 458 aa, Lactobacillus casei
MEKENKNSKRERIIHFEDTPSKSLDEVNGSVEVPHNAGFWRTLAAYTGPGILVAVGYMDPGNWITSIAGGASFKYSLLSVILISSLIAMLLQAMAARLGIVTGKDLAQMTREHTGRVMGGFLWVVTELAIMATDVAEIIGSAIALKLLFKMPLIVGIIITTTDVLILLLLMRLGFRKIEAVVATLVLVILLVFAYEVILAQPNVPEMLKGYVPHADIVTNKSMLYLSLGIVGATVMPHDLFLGSSISQTRKIDRSKPDDVKRAIKFSTIDSNLQLTMAFIVNSLLLILGAALFFGTNSSLGRFVDLFNALSNSQIVGAIASPMLSMLFAIALLASGQSSTITGTLAGQIIMEGFIHLKMPLWAQRILTRLMSVTPVLIFAIYYHGNEAKIEGLLTFSQVFLSVALPFAVIPLVRYTSDKKIMGEFANHAWVKWLAWLISAVLIILNLYLIAQTLGFVK

SEQ ID NO: 8671 - protein, 203 aa, Lactobacillus casei
MTIQEKMHNGALYQPMDADLQKEQLADIDEVAIYNRIPAPHQEERFSQLKKMFAEIGERSYVEAPFYSNFGGAHVHFGSGIYANFNLTLVDDTHIYVGDRTMFGPNVTLVTATHPIDPSLREQGYQYNKPIHVGRNCWFGANVTVMPGVTVGDNSVIGAGSLVTHDIPANVVAFGSPCRVVREITDDDRKTYDHGKPIDIESL

SEQ ID NO: 8672 - protein, 114 aa, Lactobacillus casei
MTFTFDGLVKESAEHAGLKRNQFDRQDIEDYVVYNISNIQSSLENLQAFHTLSSLSVLFEEFGVPLRISVMMKDNKTKVDYVTIRLSKAEYDEASQKVKSMVERALKRKADGEK

SEQ ID NO: 8673 - protein, 596 aa, Lactobacillus casei
MSQRSNWFYIFSKFAAKYRLKFVVILLGLCLVESVYVAGISLLPSLAVVLIQAKDLKLAMVILTILLAGVGVYVIRIFDLFLQQRLTLLTFDFRFDYVPVFSEHIFGWRQSLIDSVDGKAVIDQAYEAIYNGQNVGIGAIIAQTVTLIRTGCQIIVLLGMMGILSIWPAAIVLGLNLLQYAFQRIGNQWYFNHKGEQNQITSYQSYFVRTLMKRSTGKDIRLFAMFDLFHQHFIALIQKLVTWQRHYSNLSLIINLGQRLVNVIGLALSLLILIALQNVSIASLLFAISAIQTLNLNFGNFRDAYVTVGKNLVFVDNFRKFMAFSYRQDSGAKERKVSESGKIEVQHLAYQVNGTELVHDINFFVEPGEKVAIVGENGAGKSTLVKLLCGLYTPSSGSVAIDGQDIATWAPAAMRQRVAVEFQDDVILHFTIAENVACTTPQQIDTARVKAVLAEVGLGDFVAGLPSGIQTFIGNELSENGIQLSGGQKDKILFARVLYRQADINILDEPTSALDPISEKQFYALVDAKLYQKTTIIVTHRLGALATENVKILVMKDGTVIASGSHRWLLTNCDYYRKLWLAQRSLYVGSDGHEAS

SEQ ID NO: 8674 - protein, 619 aa, Lactobacillus casei
MLGVTAMKHRKTEIRHGIGTVRFIYRFGKSLFGLTLLISILNAVAPLIVILGNTQILNQILSNQRQSIMQIVLYFYSAAAMAYVGAAILQRFLDIASVRANERLKTAIYEAWEKVDFQQLETQGYFSKMMKSEASFRYSGCIPAFFTQFQNLVQSLVTIAAGLGLIGWIVMVGATKSGKLAIVIVMSLLLIMLGEYGLILIYQKLTHSNIKLFKYLMNLERKMNYFLMNIVNSYENIKAIKMWGLRGPIQNRYRTTWKSEKSVNHKLIINDSLSQIVTAIMASFATLVLFILVVFKIKEGLLPIGQLNTLFGSVVQMTSAVSVMIATWQQFLRFQNQVQYASDILPPEKPAASSGRVTLPLQTKNVIEFVHVSFAYADGPEVLHDISLKLDLQGVTALVGVNGSGKSTLVKLLLGLYRPTKGKILFNGQDISKFTQADYLALFKVVFQDYAIFDFSIAQNISASVDQDQGRLRDVMMNNGIAEWVDRLPNREKTAIGTYSQEDFQPSGGQRQQIAVARAQYKHGIYQILDEPSAAMDPIKELRLFSKIKQVSQDTPSLFITHRIGAVTLANKIILMRDGRIDGIGTKSSLLRQSAYFRELWHSQADMYAFDANLDAAGE

SEQ ID NO: 8675 - protein, 480 aa, Lactobacillus casei
MNQFVNHSSCTALLVGKKASVDGSTMIARNEDAAGGINPKRFIVVKPDEQPQRYVSTFNGFQLDLPQSPLQYTCTPVADTSDGTWGEAGINSDNVAMSATETEFTNTTMLGLDPLEPDGIGEEAMLTVVLPYIHSAREGVQRLGDLVTKYGTCESNGIAFSDANEIWYFETVGGHHWAAERIPDDSYVLAPNQTGIQEIDFNAPEHFQYSADLKDFADRYHLNKAKEGFNFRDIFGEDTQADHYYNTPRVWYAQKMLNPEVEQDPESRTMPFSRVPSHLISVEDVALVLSSHYQATEFDPYGQTGTPETRKRYRPIGMNRNQEMHILQIRPDMPKAHAAIHWLAEGVNIFNTPVPFFANCTTTPDNFQYTPTDKSSTASFYWLNKLIAMVADPLFAEHNWDAEVAVSESRKFGFAAGRAAVAKGDEGFSDVKPEDLPAWHDELNAETAATITNDLQYLLYRLVCIRAEKMTPTFEKGGEL

SEQ ID NO: 8676 - protein, 246 aa, Lactobacillus casei
MRLGVYNGREDVSEKATKQKEGQLIKNTKTERWIGLIVGLVLNAAGNGLCIVGAMGSGLWTAAAINLNDWQGWNIGAVLFTFGVLNALTNLILIHHWDWPRLISEIIYTLFFSYFVNVFTWVFTWLGLGSWSVLARIFVSCFGVFCFCVAISLYQRANIIMHPNDDTTNILRFMYFKGNATASQITNFIPPIIVAVIAWIATGKLLGINVATLFSFLGNGIIIAWADEHVWPQLKHNFKVTPDGQS

SEQ ID NO: 8677 - protein, 103 aa, Lactobacillus casei
MGSREEGFSLVRKVSEMKRKESVLSQLPALIADPTTTGPELEILKHAEERRQKGNNEEGIAYEIRTGLQPLAIGQKLSPKVVDFLTQVAAQYLGMGNRGNIIF

SEQ ID NO: 8678 - protein, 236 aa, Lactobacillus casei
MNDELTIRSGIHDVMPTVFGYITVGMAYGIVAKTGHLSLLMIGLMSLIVYAGSAQFVLVSMLAAGSPIGAMVISTALINARMSLMSMTVAPYLKDESMTQNVLIGTLLTDESFALSMNKLNYTNHHLNAPWFHTVNVGAYLVWFVASLLGAVIGGMIPNPDNFGLDFAVVAMFIGLLYLQMITDRSKPFLRHLSVAGVVAVAMVLLVRYLPGTTAIIIATVIGCLFGMEVERHAKS

SEQ ID NO: 8679 - protein, 109 aa, Lactobacillus casei
MQNPDTLIAILSCGLATWLLRVVPIVLVKRMTIPKWLLHFLSFVPVAILSAIFVENLLVIHVGHWPSVNWPNLLASLPAIGVAIITKSLFAVVVAGVVSMAVLRLLGWT

SEQ ID NO: 8680 - protein, 603 aa, Lactobacillus casei
METSLLYPVTNDQRTDQKLDGLWQFKFDETKQGVKDGWETGFHDGVSMPVPASFNDFFTDKESREYTGDFWYSRKFFVPSAAKGKALFLRFDAVTHRATIFVNGKEIRSHEGGFLPFTADISSAVHYGAENTVVVKGNNELSREALPAGDTITLRNGKKMVRPFFDFYNYSGLNRSVHLLTLPQERVLDYTTTFELNGQDATVNYTVTTNGDAPVTVSLADADGQVVATAQGKEGALQVKNAHLWQVRNAYLYTLTIQVGDDAQTPVDTYTDRIGIRTIKISGTNILVNDKPIYLKGFGRHEDSPFAGRAFDLNVEKKDFALMKWIGANSFRTSHYPYDEQVYKIADEEGFLLTDEVPAVGFKMAAAAFLGGLNQSFFKGPWLKKLHERHIDQIRDLIKRDKNHPSVLAWSLFNEPDTIDENAVPYFKQIFDESKDLDPQSRPRTFTLSEDDTIETSKVLDFPDFYMLNRYPGWYHFGGYQISDGEAGLRDEMDKWQKAGVTKPVVFTEFGADTEAGLHKLPSVMWTEEYQVEVLKMFSRVFDDYDFIKGEQVWNLADFQTVEGNMRVNGNKKGIFTRDRQPKEAAFFYHDRWNKLPLDYKAK

SEQ ID NO: 8681 - protein, 1448 aa, Lactobacillus casei
MKAKIIGWRPKGFNKKWLWASIATAVAAASMVLFLMIPSATRAATQNPEDPVTVKLDGNDIASNNTNGLTFKGFGVLSGNGTSALLMDYKSEHPDVYAKMMKTLFGGSQPLMTNVKLEMGNDRNNSTGSEPATQRTESESANVTRDQGFQLAADAKKLNPNLKVTILRWNAPGWAKTNDQIYTWYKNSILAAYRKYGYMVDYVNPGLNEHAPDLTWAKEYANRVKTDTTGFKNDTERKLYNNIKVVISDEVGVGSFGKKMVSDSSLRNAITAAGYHYSTEDDSAKSFTTLADKYNKEVWNSEAQATFGNSDYRPNSGTGIGGNGSSLEMANTIVKGFTDSRRTNFIYQPAIASFYEGGQYSSKSVLQATDPWSGWTNNDVALDVLAQFSKFAKLGWENSDNTSGVWRAVSQASASTATGSNPVNGRNGLANYLTLASPDKKNFSTVIVNDSKYTKHYQISATNMGYKGNPSLEEWETRAADSSATDAYNSNYLKHVGDASADSKGVYTVTVKPWSMMTVTTLDKAKDNDLKQDAATPSDKERTVLDTDTNGKGHDTSDNTLYADNYEYAGKKVATLNADGTSNTSQTEDFISSRGGNSGFYPLYTFNRNGTLEGYQSSNAKSGSYVLRQQLDSTVVAPGGAWNDGDALAWIGDNRWMNYKASTDVSFEDKGTYGSANYASIGVRQQADSGPAAYLKFWQDGGWSLHIGSQTISGNVATGQGGTKISDFDTANTAWHNIAVQAAGDTITASIDGHEVASGKVTTQLSGRVTLGSGYYHTDFDNLKVEKVKGYTPYYSQQLDDLEMYDTSAKPQKELVYNNQWTHENGQGMYVRDRTISKSTGAGATLTYTFNGTGLDICGSNDGSAKLDVTVDGKQVATNAATNKTGNLEQAYTLRNLKDGQHTVTFTVKSGTLAVDYVGVVPGENSVDFSALQTAYDKDKDTTNASNKYTTASWNAFQTALSAAKNVLANSSATQSDVDTALKNLNTAYDGLALSLDKSALQKAYDKAKDVTNSNNKYTDASWSALQTALTAAQKVLSNTDATSADIDTALKNLNTAYAGLTPSPTTNPDKAKLQAAYDKDKAVANTDNKYTADSWKTFQTAVAGAQTVLANNDATQTDVDAALQKLNDAYNSLAPTNGEKTDKSALQTAYDKDKTVTNTDNKYTDDSWKTFQSALENAQKVLADNKAVQTDVDAALQKLNDAYDGLTVNPDTKPDKSALQAAVDAAKALSDAAVTGEHEGNYPADAVTTLKDAITAAQKVLTDASASKDDVTNAFSTLNQAVATFKKAAITVNRDPLTQLAKATQALKEADYTSDSWTTFQQAFTAAQKLLAGKPSQQELNAAVTALQAAKNNLVAAGGQLPSTGGSDSSSASQAPSSSSSSATSSSTATDQTSPVSEFTSSSNKNKYPNTGESQLSLVVTVAALALLIGIGGLAWFLHEKGKAKQE

SEQ ID NO: 8682 - protein, 227 aa, Lactobacillus casei
KDPGALDLASEMQKYDYLNRLVNTGCVAVVRGNDADEAVKTVDAVIAGGVTGIELTFTVPHADKALDELSEKYADRDDVLIGAGTVLDPATARLAIIAGAKFIVSPSFNADVAKICNLYSIPYTPGCFTPTEIQTALEAGVDLVKVFPGSVAGPAMVKALHGPFPQLAIMPTGGVSLDNLETWFDAGVTLVGAGSNLTAAAKTGDYAGVTATAKKYRAKLDEIKAGK

SEQ ID NO: 8683 - protein, 323 aa, Lactobacillus casei
VNECLTIGEPLVVFAAEEADVPLAAAKHFTKYLAGAELNVAVGLSRLGHSVEYITHLGEDPNGIFIRQQLTAAGIGSDNVTTTSRYPTGIEFKARVTHGDPNTYYLRAGSAAAHFDPDAIDRVDLAGVKLAHITGIFPAASASTLAATKRLMKRLITNHIMITFDPNLRPALWPDQQTMASTINELAKSATIVLPGAAEGKILVGSDDPETIAHFYLDQSPQTQLVIVKVGKQGAYLLGRDVPDQLLPSFPAAHIVDTVGAGDGFALGVISALLEGRSPAEAASRGNAIGALAIQSAGDNTGYPTRSQLDKFMKTSLNETGHE

SEQ ID NO: 8684 - protein, 476 aa, Lactobacillus casei
MAFLDDDFLLTNEPAKQLFHQYAADLPIIDFHCHLNPEEIYENRNFKNITRIWLNEGTYGDHYKWRLERANGVPEELITGDGDDYKKFVAWCETMENAWGNPVFEWTHLELRRFFGSDLVLSRDTAKQVWDLANAKLATPEFTPRALIRRSHVEVVCTTDDPASDLHYHELIAKDEDTNGFKVLPAMRPDKLMAICANSYGEYLQTLGKAAGVEITDFASLKKAMKQRFTFFAQHGGHLSDHGLNSFHYRPASQEALDAIIKKGIENRPVSDEENDQYITGLVEMLMDLNREFNWTMQFHANVARSLSLPNLKKIGPDTGFDAMGSQPDLVGEIRDLFQAMDARGPLPKVIFYSLNPNDWLPLITMLQSFVGQGDKQHLQLGAAWWFNDTAEGMHKQLQTFAQQSLLPNFVGMLTDSRSFLSYPRHEYFRRVLCNFYGELVEQGRVPYDLEALGRIVKNISYGNARNYFGFYDNKD

SEQ ID NO: 8685 - protein, 361 aa, Lactobacillus casei
MSDLKMGFRWFGEKDDPITLQQIRQIPGTDQVVGALFDVPVGDVWPKEKIAALKKQVEDAGLKLEVIESVNIHDDIKIGLPSRDKYIENYKETIKNLSEYGIKVICYNFMPIFDWLRTNLHYQLKDGSNVMAFQHQYLKDDPHDIIDSVRNNSEGYVLPGWEPERLAEIERLFKAYADVDAAKLRENMKYFLDAIIPTCEKYDVRMAMHPDDPPRELFGLPRVYKNAEDMRVIEGMHESRYNGFTICTGSLGENPDNDVPAIIREFVKKDRAPFIHARNIKFMNKEGDFHESDHLSKDGSLDMYEIMKALHDLDYDGYIRPDHGRNIWGENGRPGYGLYDRALGIMYLHGLWEALEKGSAK

SEQ ID NO: 8686 - protein, 559 aa, Lactobacillus casei
  misc_feature (5)..(5): Xaa can be any naturally occurring amino acid
NADPXIDREDCTASEVVKLTDDYQAKADEFKAAGIAVPQFDQEQMKQATQANPVWVHFGGGNLFRCFHAKIAQDLLNTGKLKSGVIVAETYDGDVPADIYKPYNDRVLQVVMQPDGTLDKTLIASVAEAIYYNKSNPDGWERLKDIFTQPSLQLVTMSITEKGYQLTDINGKLTPAAEADIAGKPDDAVTNMGAIARLLLARYEAGAKPIAMVSTDNFSENGKRYEDGILTIAKGWAKNGTVTQGFIDYLTDPKRVSFPWSMIDRITPNPAQNVADKLKAEGFEDTTIVHTPKHTNIAPFGNTEETHYLVIEDSFPNGRPALENAGVILTDRDTVNDADQMKVTACLNPLHTALAIYGNLLGYTSIASEVENPDLLTLIKYLGYKEDLPVVKDPKIINPKKFLDQLITKRLPNKNIPDTPQRIASDTSQKLPIRYGVTIQHYLDKGPDSVKQLKAIPLILAGWCRYLMALDDKGNAFTPSRDPLLDQLQPYVADIKLGSDADVHAALKPILSNAQIFGHDLYQIGLADQVEADFKKLIAGPGAVAKTLEQFRQDHEKEL

SEQ ID NO: 8687 - protein, 525 aa, Lactobacillus casei
MTTKDSGLYPTEFWTATAGDLSQKRDHLPTPQPTAQPGNGAKIVIDPADQHQEWIGAGAAITDAAASLIWKQSKEQRSALLHELFDPEEGHFSTIRVPLGSCEPASQPFYTYDDVPFGEHDASLAKFSVGEGEPGAPDATKDLKYLIPVLQEILAINPAVKIMASPWSAPAWMKSTGQLNMGGHLRFGEYTNNGYAVKDTFEGVYAQYFVRYLEEYRKYGIPIYALSIQNEPSNAPAWPAMIWTIPQLAQFGYKYLRPALDKTFPDTKMYFWDGSLNVLDVIDKPLSELITPDEAAAFDGFAFHTYDGPYTNLFKGSRLNPNWHLAMTERRCMIEETPEDASHIMMGLIGNWLVRQGLNMIDLWNIALDERGLPNQVGATGRRGVVTIDHKTGKVQRNLEYYMLRNFNQDVAPGSIVIGSTNYTQDGYTGGLGSVAFLAPDGSIAAHIYNPSGKPLDAEVTINRDGAYAWQHVTVPAWGTVTLHKAFGPVNESKPREDEAFKLNPYPANLMDDWAPGKGVNANKK

SEQ ID NO: 8688 - protein, 431 aa, Lactobacillus casei
MADKLDKDPKAVKTTVGVVTNAKVQDSQQPKLPFGVATAMFLAPLCWYGPIGSTRSVLIPQLFSQIDAAHKVWAVGILATVASITGAIANLLFGAFSDVTRTRFGKRKPYIVLGTLVIAISLVVIANLTSITAIIFIWIIAAAAENAIAAAIYPQISDRVAPKWRGTVSTFYGVGFTIAQQGFALLAAQFLGNVKFGIYVMAATTVILAVIHVLLINEKSNLDEPKIKLDKDSLKKYFFFPTHDARDFYLALSGKFLMVVGSTIVTTFLLFIFTDYIGQSTKEAGGSISIFSSIMLFIGVFFALVGGPLADKMKRVKGPVVIATFALAIAALFPLFVKEAWAMFAYAVIAAFGNGLYNSVDGALNMDVLPSSDTAGKDLGLINLANTLGQMLGAMVASAIVEGFGYQAVFMFAVAMEILGGILIAAIKRVR

SEQ ID NO: 8689 - protein, 256 aa, Lactobacillus casei
MDLPNNSNEHRIFANDYAYQTLFSKIVAIELPPGASISPIELSKELGISRTPIQRACSRLAENGLVNVFPQRGSYVSLINFDKVYESFYLRNLLEQAAVRKVCSLPDRSELVFSLNQTIYNQRQQLDHKNYIRAFDLDNQFHHLIYDAASMTYIEQALAYIAADQDRIRHLKVLSELRIDSTLEEHFKILNSIESGDADAAAHNVYLHISKFAEDMSAIHRKYPKYFSNWTAGQDIKIAPVKESFYNFRLSHDREV

SEQ ID NO: 8690 - protein, 341 aa, Lactobacillus casei
MLAARVYGKEDIRVEEVPKPSIKSSKDVLIKVKAVGICGSDNHIYHGENPFATLPRVMGHEFVGEVVETGEAVSSVAVGDHAVIEPINYPEGGKDYAVRQGMPNVSAQLKVLGVHVDGGMQEYISVPERQVYKIDKNIPWTTAVLVEPYTIAGNSTTRGQVGLGKTLVVQGAGTIGQLILRVAKAKGATVLISDVIDSKLEFAKQNGADRIVNANKEDLVDAVRDWTNGEMANVVIDAVGAPKTFETCFDLVSVAGAIVPLGMSPEPAHIAQKPIMQKQLTIYGSRLQAYQFAPIIKAIENGQIGNDGVVTQEFNIKDVQKAFDLMNQHPEKARKIILTFD

SEQ ID NO: 8691 - protein, 233 aa, Lactobacillus casei
VTPMQISNYQDEAYNAIKQMILSMQLTPGEKVDKNDLSAQLKIGATPIREAIIRLRREGLFDVIPQSGTYVSKINLEEMYQGRFARVNLERTIVADAVNIMTPEQIAKLEQQVALQGVYENSRDYEHFFDLDHDFHEIFYMADHKQYVWTWVQQMNLQFNRYRYLRLEASGLQWHNIVTEHQAIVDAVKAKDAELASHLVADHLLAIDDDVKTVLNAYPDYFEGQATPNHQPN

SEQ ID NO: 8692 - protein, 339 aa, Lactobacillus casei
MTKVLTFGEMMLRLKPYDHQRILQASGFEANYGGSEANVAVSLALLGDQAQYVTKLPDNALGDTARNTIRGLGVDTHKILRGGPRLGIYFFEKGASVRNTNVVYDRAGSSFATAEADEFDWASLLKDVAYFYFSGITPAISPAMKTAIESAVKYCAAHDITVVCDMNYRGKMWTPAEAQDFFGKVMPYITIVLANDEDFEATLGIKAFDGNMETGIDQIDSFKAGMLQVMKQWPNVKTVASVVRNIHSVEDSWWTGLLAENGKTYQGPTFHMHVMEGVASGDAFGAGLMHATLHDFDPQAKINYAISASVLKLTISGDLNLITDADVRAVMATGSGVDR

SEQ ID NO: 8693 - protein, 839 aa, Lactobacillus casei
MHTLTIDGDQLQLDQNEANTIKGFGLLSCNNTSRLLMDYKWEQPKVYQQVLQHLFGGEHPLMRMLKVELGSDSNTSCGTEPAPQRAADEPANVARGMGFQLIADAKKIQPDLKTCMLRWAEPGFLRPTWQQVKSDDPDQKVPSASFEGMYQYYKQTVIAAWQAYGYVFDYIDPDRNETKHPMYRYLKWFAHRLQNDQDDFPEGFPLVDYHAIKLITSDQNYGTDMGTELLKDPELQAVIPAVGYHYNTDDGPDHPFTQIADQLHKEVWYSEGVAPVTFGTLRVQDTTGIGIGGFISALDVANRLVKSYARSRRSLYIFQPAIGGLYPGAKYPGKQLLEMDTPWSGYFQQDTVGLVVMHHFTDFALTGWRDQTADKNWRYVPSATVSEVAGTENLSQAFGAASAMTLVAPDRADYTVILVNDTNAPQHYQVSVKDLPAANKPVHVWQTWADENGKIHDREQVATLTPKDGVVTVTIAPRAIVSATTADFQPQAQLTSPAVSQDQPLQQDPEKHVLFHDDYTYADMPEDYLKRRGGTPRYTTDMDGAFEVVEHAGKPVLQQQITEQSRALAWETQTDPNFTVGDIRWLNYAAALTFTFDTTTQQNTVSANYVGLGVRSVDDFEGSLFSAPYAATITVGGKLRFYVRGDLQNTLDVPVFDAAASHELVVQATDRHITVQVDGKTYVTYDDPSSQPGLAGQVKVGTGYFKTVIHSLTVTSTSATAVLGHRCDDLDASLAFSDEHWARIAARFPHAWERSQSTGEQGATLDFDTDGTGFVLFGTQDQPSRLRITVDGRAQEVVPLTALAKQPNAMVTDLAAGQHHVTVTVIDGSYTFDGVAPIL

SEQ ID NO: 8694 - protein, 305 aa, Lactobacillus casei
VTQPAYGYLMSYFTGEQYQNGEQIYFALSRDGLHFTALHDNTPVVTNQLGTHGARDPFLFRTQAGDYVLLATDLRMYGHTEPGAWTRAEVAGSDQLLVWHSKDLVTWDQGESVTLGPHFGCVWAPEAIFDPDHGDDRLFWSATDTTENPKRLRIYSAHTKDFQHFTTPEIYLSDATYDVIDLDVVAADGGFYRFWKLNQRGQVVMDRVAHLDNAAGHPIASTYLANMQRVEGPQAYQLPDGQWCLLLDQVNNDVRAYVPALTEDLASGQFTQPSAGTYQLPDRPRHGSVLPIDQAAYARLIKRWQ

SEQ ID NO: 8695 - protein, 87 aa, Lactobacillus casei
MTAKVKMSSEGQIVIPIEMRNQLHLDENSELVATIVDDKIVIRALPTADEWTDLFKNTPTEVVNLDKRGHYDPEKSPAFHDWMHEND

SEQ ID NO: 8696 - protein, 70 aa, Lactobacillus casei
MDNHLRVLMSGLNPSMGTNLKFGAVGTVGGGFAGYDMYVLGYPGDYLDVTNHRVVSKKKFLKQYQMLEDV

SEQ ID NO: 8697 - protein, 33 aa, Lactobacillus casei
MGKYKVFCIQILEVALFTPQKKIATCTIPNKYN

SEQ ID NO: 8698 - protein, 388 aa, Lactobacillus casei
MRKLTSICFYLLTGILFILAILSALFLDSNWLAYSVTIVLFAGIIYLKRFKKLKPFWLQLTATLLFFGVSLITITLTRPNLTVSLYGNLVNNSLKMANHMYEAKHGISLFVKKIETESKPYRAKDWQSPAGYTNKTINLGKARGYMLSANKGKHTKVIYQIHGGGYLAQFSNTYNKAAVNYSNADNQANVFSLDYRTAPKHPFPAALNDALTGYQYLLKHGYQAKNIIIAGDSSGAGLSLALTLYLRDHKDPLPAALVLASPWADLTASGKSYRTNTTKDPLFGSASSKKSPRHPIPITYAGKHNLKNPYISPVFGNFKDFPPMLIQTGSNELLLSDSKTIVKKARAAKVHVKFLEFSGMYHIFYISTPQIPEGQRAWANIRSFVSKY

SEQ ID NO: 8699 - protein, 178 aa, Lactobacillus casei
MIKYKDTEKRIWQAFFQLLEVEKFEKITINEICKQSKISRTTFYRHYVDKYRLLSTINHYFSTSLGYFLKHRVHQENITASLVDIAKFLSVNSEVILVLLTIHTPESDLQELFKKVLHIEFADYVTRQHKSSVFPSNYLIEIYVAISMVFLSYSLRNGLDVDVIRSIDDIQKHIFATL

SEQ ID NO: 8700 - protein, 460 aa, Lactobacillus casei
MTTSPVSHRTQLAILSAGLLTFVGILVETSMNVTFPTLIKTLHVSLSTVQWLTSGYLLMVTLVMSTTAFLLRRFNTRSLFRGAVLCALAGTVLCIWAPNFPTLFAGRLLQALATGVSTPLMFHLILTLIPQAHLGLYVGMASVVTSLAPALGPTYGGLLTYYASWRMIFWLVLPVILLVWSMGEATIRVKARATDERFDFMGFLLLAVGLFSLIELLDQFTAAGITVAFWIYGAALAVAIIGMGAHLRRTSTPLLNFSLLKHAGIRARAINFFILQFGNIGIAFVIPIFAENVLHTNASVAGLLLLPGSLLGAAVSPIGGALYDRFGAHRLLLISDAAMVVGAMLLGLFTHQLGMALIVGFYLIFRVGFNLGFGNTMSDASTMVDGPAKADINSLFNTLQQYAGSLGTASLSAIITLQQRLAPTGAEATGSQIDFFLLAGLAALTFVIQWRLGDRHQQAA

SEQ ID NO: 8701 - protein, 1120 aa, Lactobacillus casei
LKNLRNRHIPALIFWLVVILVTLVTMPDVSGIVRDKGALSLPKNEESQVAANIEKRANHNQKVRSFALVFSNGDKKLTAIQKKAITKTLKGLKDSKAVKIVNVTQSSDNAETKKQLDAKDGTTQMALVDVKAKGQVRPQTKNLEQQIKTANVKTYVTGSDVLNDDFATVTEKGIQKTEIIAAIFIFIVLIIVFRSPIVPLVSLLTVAISFLTSLNIIMTLADKANFPISNFTQVFLVVVLFGIGTDYNILLYDDFKAALSQGIPRTKAAGIARRFGGRTILYSGLSVLIGFSVLGLANFKFYRSAVGVAIGVLILLTVLLTLNMFFMATMGEKLFWPSKNLDGHSTSRLWHGLSKVGIARPLITLGVIGIIAVPFLLNANQTLNFNNADELPETLQSKVGYRLIQDHYSKGMASPTTIYIQSKHPLNSQTVLGTIDDVTTYLQKEKGVKTVASVTQPGGSKIKSLYLNDQLKTINSGLTQSVKGLKQVQAGLNDANTQIKNANVAGSTQQVQTLADGTTTLSSGATSLSSGISQYTSGVTSLNNGLGQLSSQLPTLTSGVNTLSTGSTQLAKGMNELNSNSTVLASGMNQLSSKSGELTSGMDTLNNQIQTLTGTAQQIITLINQLPDASQLTQPILDKINAFSSGVQQLTDGTSALGDGIKTLNAGTTAMNNGIGTLTSGTNQLNSGINSLNSQVPTLVSGVNQLSSGSSQLASQNGTLNNGASQIASGADQVNTGVQTLNTKIKAISQQVSSMQSGLTSANQALGTIADGSTSMKQYLTELQRSYLGKKFYIPNATLKSKTFKPALATYMADNNKITKFTVVLKGDPSTDAAAQQIKAIKADLTAKLKHTPLDDATVAIGGQTSQTADLQDLANGDFERTAAIMIIGIGIALIVVTRSVIQPISIITTLLMAYITSLGLTRLFSTYVLGRAMLTWNTPFFSFIMLVALGVDYSIFLMVRYRDNALEGGTMTQRIAKAATVIGAVVISAAVILSGTFAAMIPSGITTLIQVALAVIIGLILLVFLLPLVMSSVISLTDKQMHKNNHPQGPGPAPDSDAPDPDGPTKPTPKAPVVTTAAANSTPKHPQPSSHAAPRVHLAAMPKADSQASMSKTSRQRSK

SEQ ID NO: 8702 - protein, 200 aa, Lactobacillus casei
MASIPVPSPIIEQAVKLFAERGYAETNLPSIAKAAKVAVGTIYRHFKSKEDILNTAFTDIMNFFHNSLAEAADCDPDDPETMFGRLFDAATASMEQYPTELHFIQQNVFNEALNAESRAARGRVITLINNMLMDGQDRGVIVKADVRTQLAILYGSIVSMIDIVWAQQQIEGHVSNQKALAADLKNQVWNGLTSERRVFN

SEQ ID NO: 8703 - protein, 254 aa, Lactobacillus casei
VCTALPNIMAFIIIAIGNIIIGGLVGMTGVAGFLLPILYTAGLGYSTTEGLAFSFLAFIISGWLGSRHYQRQGLMDRRIAYLLSGGSFVGAILGVRLNLLLPTSWVQLLLYLVVLLSGIAILIQQRYPPKPGVDHLNHPVLLVILGIVTGLICALSGAGGPVLVMPLLVLLGCEPHAAVGIALLNSVFISLPAAVGYLSQIQLMNTLPLLAIILVTHGLGVIIGSRLGPKIDGRLLKNGTAIFSIILGCIKLWP

SEQ ID NO: 8704 - protein, 443 aa, Lactobacillus casei
LASTLIQDTLTMTAPGEIKPHQDIFIKNGKIAQVGDHGSFPAEADDVIDGTHRLFMPGLIDSHLHTGQQLLRGRVLDTKGIIWKKIMLPFEADTTPETMTLNAQLAALEMITSGTTGFVDAGGYHMAAAGTVYAQSGLRGALAYSTMDDPRLPASINMDAKTAIAHTDALYDQFHGRHHLQVYYSLRALNNCSDELVDLAAQRAADRHTFLEAHMNEYPQEVAGILTRCGERPYVYLAKRGALSDHFLGAHSLFLDDAEKALIEKYHVKLNHSPFSNSGKGVPPTPELLKAGVSIGLGTDGAAHGGLSLWQEMKIFRAIMTLHYGVPQHIANIMPATTIMSLVLDGGAAALNMPGQLGRIAPGYQADIIGLDIDSPHLWPTGNWNNTLLESVNANDVADSMVAGKWLMRKRKVLTLDVERIKAVCARRYPTLWHSSSSQLATS

SEQ ID NO: 8705 - protein, 148 aa, Lactobacillus casei
MRLREWLFLLSVCGVGTLLANWIGSGVSIAKSLPGVVILIAITLVAVVLAKIMPFKLPIIAYCSVLGLLVAAPFSPIAAVVISSTKVIAFAAPFTVVGSFAGIAISDKLGTFIHQGWKYIIVGVAVMTGTFVGSLLWDTLTLKLTGVI

SEQ ID NO: 8706 - protein, 280 aa, Lactobacillus casei
MTYPSLRARIKVEWKSYLVAALFTAIAEYIGTVKLKVGPGMIILFPVFYAIILGMLSGPQVMHWFDNKHVKAASKLVIVGICPFVVNLGITAGANMDMILHAGPALLVHGFGNLLGIFFGLPLAMLLGLRRESIGATSSLNREYHLALINSAYGSDSDEASGSMAIYIVGGILGTIYFGIMATVLGMTGWFDPKALGMSTGVGAGIFMASASASLAQLFPHDANTITAMASAANTIAGITGIYITMFLAIPLTDKLYTILDKMFAGRRAKTPAAVKGRIK

SEQ ID NO: 8707 - protein, 182 aa, Lactobacillus casei
MDSPATDFIAKVLHDKLYQHQDYVVHYQSTLMNGKKVNSASFFIKNQAGELIGMICINTDVSRFQQLATLEKLSEELLQAFQPELAPAADLLESTPPTENLFIQPEGAIRQVVIEQTGTPNPPIADLTRKEKIAIVRRLYEQHFFELKDAVAKTAAYLNMSTVSIYKYLQIIKQADKSTSYE

SEQ ID NO: 8708 - protein, 381 aa, Lactobacillus casei
VGINTDLLHGYPVIDSHTGASSIPKYQASTFNSPALGTSRDYMYTRFGNPTIDALQEGLAKMTGAQFSFVFSSGMAAIANTIMLLNAGDQIIFPVEVYGGTGAFATKILPKYGIDVVFTAYDQLANIEQALTPKTKMIYVETPSNPLLKVTDIQPIVTLAKAHGILTVADNTFMTPLYQKPLALGCDIVIESLTKFINGHSDVVAGAVLTNNQAIAEELSLFQKEFGSILGVEDAWLVLRGMKTMGLRMQQSTQNAQSIAAFLQAHPKIKQVYFPGLPEHPGHAVHMQQAENGGAVLSFEIAGADKARLNTFIEALQLPIFAVSLGGVESILSHPATMSHACLTAEERAAQGVTDSLLRLSCGIEDTEDLIADLTQALAKI

SEQ ID NO: 8709 - protein, 127 aa, Lactobacillus casei
MIKRLTSTHIPAPLGSYAAATQIGSVLFTSGQLPLSPESKAVPEGIIAQTKQVMTNLNHVLVDNGTSFDHVAKTTVYINDLKLLASFDQVYRTYFHDGYPARTAVLVSELPAQALLEVDMVAEVPED

SEQ ID NO: 8710 - protein, 460 aa, Lactobacillus casei
MKKKIGFWSIVLLAINSIIGSGIFLSPGAVVQSSGSKALILYGIAAFFAAILAVTFAAAAKYVAHSGAAYIYAKAAFGEHVGFYVGITRYIATCIAWGVMATAVVKTVLRIFGFDQNDLMLVTISLILLMLALLVINCFGPKFFELVNNLSTIGKLAALLVFIIFGVGVIATTGVNHFAQIDRLTSAGSSATLSTLVMGVIAAFYAFTGFESVASGADDMYKPEKNLPIAIPLAISVIAVVYIGVVWIAMMVNPQAMMATKEVVALVAVFNNPLIQNIVLYGALISMLGINVAASFHSPRVLEAIAKQGQLPSWLAGRTAKNFPLPAFLLTIALAVLLPMAFRYDMTSIIILSSISRFVQFLIIPLCVMKFFRGRGDRRLINPARPNVLTDMVCPAVSLILTVLLLIKFDWIGQFTILDANNQHAPNYFAIVAMILGYVVIPFGMMLFNYQTKKKRYEYD

SEQ ID NO: 8711 - protein, 250 aa, Lactobacillus casei
MKKPLIGISAGVLVDQGGMFPGYKRDYVNEDYITAVSENGGIPVILPLLDDPADIDRQVAALDGLILSGGHDVDPSSYNHDPLDKLGDTSLRRDAFDLNLIRSAKQRQLPILGICRGTQILNVYHGGTLYQDLSYRDAPTIRHWQATNSAQVTHAVRIDQHSRLFTILKQATVRVNSFHHQIMATIGEGFHVVATASDNVPEAIEADGDHIMMGVQWHPEMLTHSQPLMNALFSHFIQQTQATAASSTSL

SEQ ID NO: 8712 - protein, 220 aa, Lactobacillus casei
MANMDTWQQFWYYLANNGSYVLSQFARHFLISIYGVLIAAVIGIPVGLAIARHRTLSNTVIGTANVIQTIPSLAMLSIIMLGLGLGVNTVIVTVFLYSLLPIIKNTYTGMQNVDKNLMDAAKGMGMTRWQSLYMVEIPLSMSVIMAGIRNALVVAIGITAIGAFVGAGGLGDIIIRGTNATNGGAIILAGALPTALMAIISDLVLGFLERRLEPKGKAAS

SEQ ID NO: 8713 - protein, 309 aa, Lactobacillus casei
MKQFKKLFLSLLLIPVLLLSGCGFPGLGGSGNDGTVRIASQTSTESQIMANIIAELINHELGYKTTLVNNLGSGTVVHQAMVRNDADISATRYTGTEITGTLGMNPVKNSAKATAIVKREFKKRYDQTWYPSYGFSDTYAFMVTQKEAKEDNLNTVSDLKKVAPQYNAGVDSSWMNRKGDGYSDFTKAYGFDFKRVYPMQIGLVYDAVEANRMQTVLGYSTDGRIRSYNLKVLKDDKNFFPPYQCSLVVNNSLLKKYPKLKPLLHRLDGKINLKTMQELNYQVDDQLLEPNVVAQKFLAKHNYFKGSDD

SEQ ID NO: 8714 - protein, 209 aa, Lactobacillus casei
MFAFLNAHGSELITKTWEQLYISAIALGLGVIAAVPLGILLTRFPKTAKVVIGIASMLQTVPSLALLALMIPLFGIGKVPAIVALFIYSLLPILRNTYIGMEDVDPVLIDAAKGMGMTAMQSIRQVEVPLAMPVIMAGIRLSAIYVIAWATLASYIGAGGLGDLIFNGLNLFQPDLIIGGTIPVTILALVVDWLLGRLEYHLTPVSERA

SEQ ID NO: 8715 - protein, 415 aa, Lactobacillus casei
MPEEQPMVQFKDVEKVYRGGNVAVEHINLEIHKGEFVCLIGTSGSGKTTTMRMINRMLEPSGGQILFNGKDIHKIDAVKLRRQIGYVIQNIGLMPHMTIYENITIVPKLLKWPEEKRREKAKELVDLVELPEDYLDRYPSELSGGQQQRIGVIRALAANQDLILMDEPYGALDPITREALQELIKNLQEKLGKTVVFVTHDMDEALKLATKIVVMDHGHIIQNATPTELLTHPANKFVENLVGQDRLVQARADVTTVEQIMLKNPAAITPGKSLAEAISLMRKRRVDTLLVTDDENHLKGFIDLESLETRYQSATSVGDITKSSIFYVNKNALLRDTADRILKRGFKYVPVVDNDQKLVGIVTRASLVDVVYDTIWGENEDDQASDSAKESATPTNHEPATDSAAADDRDAPKEV

SEQ ID NO: 8716 - protein, 251 aa, Lactobacillus casei
  misc_feature (4)..(4): Xaa can be any naturally occurring amino acid
CAAXAMINTERMINALPRTEASESELFIMMNITYLEKAKSILWGIILFIPILYLADGVSLVGTFTTNITLTWIFVFGSAAISITLLTLLDRKIQNRPSSQKQQSSYLKYLLLPIIWAIFIVVVNLVLNNLAFLPHSSENVLQSETAQLLKGSLRWPMMLAVCLFGPICEELAFRGVIEHYLSKFFSYWVAVVVTALIFVLLHAEAIIPSLSLFIFAVGLSVLNKNSGTLRTSIIAHITYNVLVTILVMIQL

SEQ ID NO: 8717 - protein, 104 aa, Lactobacillus casei
MFKHNKKPDDKEKVLSAYYDFVLDPNITDRERKIGLLAKDDIERGRYFVAVLNQTLISFQREAMRTGLTKDASKFYDFLEPILNRNVPFGTNRGAYGTLSGYLD

SEQ ID NO: 8718 - protein, 252 aa, Lactobacillus casei
LLNIYILEDNPAYLKTLTHELKNFIMIEELSATIKLATASPKTLLQTIKPAAEEDSLYLLDIEIDNSDLSGVDVATAIRNASLFTDIIFVTNHTEAALSILTHKIAPLDLIDKNAPIAETSNQLRRDIQQVLDRVEDRKIRSHNQFNYSVNGQMFAVPLDELIYIQTATGNPGNLEVHALNETATFHDNLNHIASLYPTLFRVHKSVLVNPDHIKQLDTNNHYLYMDNDAKLDVSFRKQKLLKKMLNHHHSK

SEQ ID NO: 8719 - protein, 435 aa, Lactobacillus casei
LTPVPGFEYFFTFLPIYIAGISVLSLIFYARLKPGYIFFWSALGMTLSTLFSTSGEILFGILYIAFMAYTDKPADMLWIFLFMDLNLVNVNIQTIFVGVAEVFAPQMVDVIGWTGIFISVTLYCFLVTWLLLTKMHVLLTVREFMQQNHGIAKSIIISTGTICLLLYVLEVVLNFLTIPTPVEMFVLCVFLLSIGINAFSIFSLLKAFKYNMELTWLKQAEMARRQYSATIDEQRKQTNKILHDYKNLLLTLQVSLNETDKESSSSSSTQAIIKQAQNSLSTAEISNDMLAAVESIPLKSLLYLKWNEAANKGVEMLIRTDKRIPDVRADLGLTVVRILGILIDNALDETVKLKEHQFEVLLLYKPSTGIELTVVNNVPTNFDLKVLDGSGFTTKGPNHGQGMAIINELVQKYPDLNVRKKKRQNHLEISLFVGE

SEQ ID NO: 8720 - protein, 241 aa, Lactobacillus casei
  misc_feature (4)..(4): Xaa can be any naturally occurring amino acid
CAAXAMINTERMINALPRTEASESELFIMMNITYMRGVVNQVQKQISEDYKHTLFLPIIFGLLVPPFIIAMANENEIGFISFIGMTILWAYVLFTYGYLRCLGVFKVSVDRAVKGLLVAMVILLFQMLIMFLTKAQGGVGQFRGLHLNILLPVACLIGPAWEETIFRYAINIKFFKGGFKGVCVSSALFAVAHGSTRLVDLLVYFGMGFLLCLANRGREDIFASVLAHSIINVVAVLAFVE

SEQ ID NO: 8721 - protein, 566 aa, Lactobacillus casei
MKKTVSVVIATCIGIFLCMLDTTIMNIALPAIQIGLNVNLSDLSWALNIYTILFATLTIPLSKLAERVGINRFYLIGLVTFALGSLVSAFATNIVLLDVGRAIQSVGAATVFPLSMTIGISTVDTSNRPKVIAALGVTQGLAAALGPVIGGIVTQFLSWRWIFLINIPLMILVLLLVTFNLSMNQERNAKPIDLQGCILSMITLFSLTLLLIKGREWGWTSFSVICLVISFLAGCIAFVFTEHFSKNPMVPLDLFKSRQFVGASVAIVLSNLFLVGVTVILPTYFTNIQQKTELTAALIITPITVMIFIFSTVAALIIDKVGARIVVLLGFVLMAVGYAMFFTVNLYNSLEVFVACTILGTGYGIIAGPITVLAAADFTGEKLNSSQSVAGVLRQVGVVLAVAIFVTNLYAGLASAKVSSVQFASGRIQRLTIPQKQKSMMLKTTKDAISTGKTHQRFPVDHFSKIERRAMIHTNYVAAVSRIISPSNSEKVQIMRQVKKKVDLVLIKQNHNINAAIGDIQTKSESYFTNAFKLLYRNTLPFLFFAILASFIFPAFKREKVRNVRH

SEQ ID NO: 8722 - protein, 174 aa, Lactobacillus casei
LQGKDVVLGLLNQRDMSGYEIKEVFETQLKFFFDGTFGMIYPILRKLEKDGLIQKKHVVQDLKPNKNIYSITELGKKEFMTYLNSKTVEETFKSDFLMRMYFGQDLDRDKVISFVEQEITRKKTNLSELTDNYERWTDNGMNSFQEITFMYGIAYYKSEIEVLDKALEQLKNQN

SEQ ID NO: 8723 - protein, 636 aa, Lactobacillus casei
MPRYTELDTKVHVQEGKTMHFIQTHKQEAMISGGVLTALGLVFSQAWLLVLASLVAGLPIAVNAWEALRYKQISIELLVTIALVGAVLIGEPVESAVVSFLFLFGDWLEQRSLAKTRSAIQGLAAAAPKTARRVDGSTVPVGQLAVGDQVRVLAGETVPADGKVIGGHANIVEAAITGEPDAKRKQAGATVYSGTQISDGTVDIEVEKTGYNTVYQQIIDLIEDAQDAQSPVATFIQKFARWYTPLVLVIALIVGLVSRDVRLAITILVLGCPGALVIGAPVSNVVGLGFGAKHGILIKGGDVATKLDQIDTVMFDKTGTLTQGKISVVTAQYWAADRANVAEMVAAVEAATAHPLGQALVAYLQPQTTKTVEDVRVTRGVGVQAQVAGHTVSVGNQKILKQPQTLEQQEAIQAIVSGGASLVLATIDDKLVAAYGLRDQLRSDTATMLADLTASGKKTIVLSGDSQAAVEHMMTDLPLSQTHGGLLPADKVSAIKAAQARGEKVMFVGDGINDGPALAQADVGVAMGSGMDVAIDTADVILTSSRLTNLGVLFNLAKRMNNNIKQNLVIAIGTVALLLSGLLVGLVDMASGMLFHEISILLVIANALRLRHTPRKWQNLTAIKAHQPQTVNNEGK

SEQ ID NO: 8724 - protein, 75 aa, Lactobacillus casei
MTKLVYQLDGLTCPSCLQKIEGAVGQQAGVKSVKALFNSSKVKAQIDPAVTNADTLKKTITDLGYTVVNVRSQEA

SEQ ID NO: 8725 - protein, 193 aa, Lactobacillus casei
MSVTTGMQTVSAEQVKARQAAAAKQADHDHHVPTAGAMSGHVLANLQVLARKLEQFRLTLNGSSSETDRQLLTELLEQARQHFAVLASDLAAQGEDFPTTTAEFNEYTMLKEDPALRFWTNDMKLDAVVNDLDTCQLFVSRAIPLANKENKLVLAADMLQLQHWHEQSILRLQTRLGRAVTAGRELLDEDEDD

SEQ ID NO: 8726 - protein, 218 aa, Lactobacillus casei
LHSCTAVVPLFKKLDDKARAAIDALTHERQVEKGTVLISPDTDARLLVVAQGKLKTYQLATNGKEQLLRVDGPGDYEGEAGLLNIASPNVYTEALTTATVCTISASDFQQLLMKQPQISLQLLTENTRKMQALEKQAGYLGNDSINVRLTHYLLDLRTAAGKDTVTVPMAWTQLADYLGTTPETVSRTLKLLANEKLIRRTGKQVTILNAEDMEDFVW

SEQ ID NO: 8727 - protein, 288 aa, Lactobacillus casei
  misc_feature (4)..(4): Xaa can be any naturally occurring amino acid
CAAXAMINTERMINALPRTEASESELFIMMNITYMGLFGTLKDEANIPQSFDLLFLFGEAIGIIGMVIYYRGDRDILPFAKDHAARNYSLGLLFGFMMFSLIWGIITLFGGYQVLVIFQGSNLLWLVLFFIGYAIQSMFEELLCRGYVMGYWLKQNKVIMAVLLNAILFTLLHMANPGFNLPAAIGLFLFAIAMSQFRLLTGSIWLCGAFHAIWNFAEGPIFGVSVSGLSGESFILKSLPTTTFQPLTGGTFGLEASTVSAIVHLLLVILLAIIILKKQRTGLTISEN

SEQ ID NO: 8728 - protein, 422 aa, Lactobacillus casei
NADHDEHYDRGENASELIKEPRTEINMADVVILGAGYAGIRAVKTLSKLAPKGTTITVVDQNAEHEERTQLHEVAAGTVPASKITFNIQQVLPKDVQFLQAKVSKVDVSTKMVILANHAPLRYDYLIIALGFRSEDFGLPGAAENALPLDNVTSAETITKTIEQHVANYKQSQDPKDLTVIVAGAGFTGVELLGELTHSMPALAKKYDTPPIKIISMEMATRILPMFDEKLANYAMDYLKSHGVTMMTGSKITKIEPNAVVYADGDQEKKVEGNTIIWTVGVSGSDVIADSGFKQRRNRVVVSNHLNLDDHPEVFIIGDVSAVMAGDSGRPYPTTAQISTQEGDQAGKNVAAALNGQPLTDFVYKPKGTVASLGSQDGIAQIGKGHKYTGFIAKMLKRVITDKSLLEDANLATMLKQGRWPL

SEQ ID NO: 8729 - protein, 103 aa, Lactobacillus casei
MKWLPRTESALGFALIIYFYFVQFNFSWLLFVVGFLIPDISALGFLANEKTGNVCYDIGHTLIGPIILGGLALLGAWYGLLAAALIWSAHILGDRTLGFGLRY

SEQ ID NO: 8730 - protein, 193 aa, Lactobacillus casei
MNGKQRMALQSKQWLVDALVTLMQRGEAVTDISITEIVQTADLSRKTFYRAFKTKDDLIDYLCRQLTDDYFESLKQATRGQTPISFETTMQHFFTFWWQQKDLVRLLIRQGLFDHLNGVWQRDAVDKYRQFPAPWHAAGTDREVNYIMAFALGGFTNVLRLWLAQDQPEPPEQVQRVALAGFGQLAQSIGHSN

SEQ ID NO: 8731 - protein, 240 aa, Lactobacillus casei
MKRLGWFSLLTLSLIYILIPAQTASAQSTTAGNKAPVAKQIKISNVHQSLNLKFHLPARTDYSLKDLNNQTLAEKKSASGVVSLKRLQSSSTKLILKTSRNRHTSKQVINVPESYPIAHPAIYRKPVIVGSKVTYVGAKRLRLFTIQTKYLPDIPKNQTGIALTIHNAHYAVPLSFSEKHFSASNDQHQVAVKMLSTPPVIKPNETKTIRLLIDVPQGKSINGTLALDQVNLTAPINFYL

SEQ ID NO: 8732 - protein, 193 aa, Lactobacillus casei
MECVFGIDVSKENANVAVLVDNVVIKQFKIGLDRLGFSLLSDELNSFNAPLIIYEATAMYSRRLRAFLQRDGWKYTELNPLAAKKVMEEFRHTKTDALDAVGLARAMIKNRFRPTYQESPVYTELHDLERTYQQFNKDIVTNKNRLHRALQLTFPEIEHFMSSTDGVLYWHIVQRFPHPAIVLSQESAYIHLN

SEQ ID NO: 8733 - protein, 463 aa, Lactobacillus casei
MTTNKQKRLSKATIDHANHVAIVAIAEANGIALVQQSNGYWRGVEHDSLVINDKKNLFRWNSRDVGGGALDFVQHYLGISSFREAVAYLNHAALERADTITHKAREPFQYNFKNSPNFEQATKYLTTVRKLDPQIVDLLHRKGFIQQDEHGNAIFVWSRKDKIVGATVQGTRIDHEHLGKRGTFKQIAKNSQENFGFNLSLGKPERLLMFEAPIDALSYWSLHRGLNHVTLMSMDGLKPNTVKQGLIYFCEKTGHAPSEIAFGVDNDPSGHVFYDQMRAEHALASVPYTSLIPADQAIPHECLAPVVSAAKQAAIPTVALMAYLKVAVNLQPGHGMANGYHYQDAFTKGSFADLPEFAKQLKPYLQPNGIDWQAYFKQQAPDLTIANRNNLITRITEVAQRYQKGDFQVVRDVPKDWNDRLQIHDRSKSKGLTLDQKIAAAKERAVTANLRIAPKHHDQALER

SEQ ID NO: 8734 - protein, 735 aa, Lactobacillus casei
MAITKIHAINRSTKAAIKYIIDPLKTRNGELVEGIHCDVPTASFEFEMLADMSHRYNGNYERVGGRDVDGIRRHQSAKSYHLIQSFSPDDHVTPEEAHAIGVQLMRELLGNDYQFVIATHVDKDHIHNHIVFNAYSMTTLKKFRSQPYITANRIKEISNRLTAEHGLSVSLRRDEQLEKNGFVHEKDVHQSFRAELRRRLRFVASRATSPEMFDQLCEQLEITTTKRGQDRGYRLPDQQRNIRDKSLSDIGSYTSEGIKTTTAENADNQLRLMALIDDVYGMCDSLDDLTFMLQQEHDVTLKRQRNGSYQFTFHDGTKVPAELLPPAYQLNYMNEHWHDPNALKAKVAAPDVLAEYQEQTKSKMTNTETLMDLSDDQVLSVDEKGALVQLEVPNEGQLTVHLNRYELRGDSDHLQVALQANYYYTLTDQSGKRPRAVSIRGEALIHAIDLDQGLNPELVKVPPQAVFGHSDKGLTITLPDAGYERVFIPNNAVNYDRLHQQYTVQIGNRWHYNATPFATLNDPEPKSVSLTGAALKPALKSTQPMLGRWLIANRQRQYMQAQQADVKRLSTTLGELRANHITDRQSLGRQVTTVKAQLHDVQQKIEMLHDKITTYNDLAKFIFTRNQYQPIIDKLEDVSPNEQHRLTRKYQHEINMYQTAVLHLQNQDFNPLLTNEEMASVITDQEKTLRSLEQSLKQQTIMVNKWEDIADLMDDLQGEPPQEEQEQQHHHDIER

SEQ ID NO: 8735 - protein, 133 aa, Lactobacillus casei
VKQSDEHRTRSSRSTVRMTPEEREWVNFRIATAGNPKFNAYACRALLTSKIIHVDFTDTKELIRQMARIGNNLNQLAHVANENEVLTQEQMNMVKSEVDDLFWAVNDHLLHRLDVVKHYERVVLNGNHENTRD

SEQ ID NO: 8736 - protein, 91 aa, Lactobacillus casei
MKTIDEMNEFDRDIILLHRKSVSEDTPPAILKKVKAVRDDISNDLTGITDPIEKEFTLECYDETIRKLSDLSVEDYQKWLSQNESLEEFEL

SEQ ID NO: 8737 - protein, 324 aa, Lactobacillus casei
MPTSSQEKQPPKSTKELLALAQDGAKKVFSTDEYREYLKFISGFHQYSVRNQLLIYLQNPHATFVAGYHTWKNQYHRQVNQHEKGIRILAGGEHKYEKRVRQPDGTIKRVKESKVFCRPAAVFDYSQTSGEPIKMFTHELTGEVPNYATIYSKLVQATDFHVGFSREMPSSETKGVTRPRQKEIQLRSGMSEKQTIKTLIHELAHSELHCDPKLKLDRSTMELEAESTAFIVCQHLGIDTSDYTFPYLAVWSKDKDLSQLSKSLTRIQSTAEKFNKTVDQNLEKIREKPLTLDQKIERAKTIATTENIAKKEQGLVQATQEKTR

SEQ ID NO: 8738 - protein, 381 aa, Lactobacillus casei
VGRKKDKETDTIKITNQEGIALATDPQPFDDGLAQLQAASDHLFDLAQHGSCQITAYHRDQVAFSVKIKLPIEGKIEDLITDLISQRQEVTSPPETDVSVANETEPDSASEPVSTDSLAADTTPKRTRNRSHRTVAKKPKRTAIKLPSISLPKVSRSFLKHLITIAVLLIIAGGFLFGTKLVVDAYNAPPSYTSLIKKGDYLQAGKLYPNRRDDVRKTLTDQSNVKQLAKFQRIYPKAETLFDLAYLQHDYSKVIAMSNRVTLSQERQIELAVAYVHTKQFDAAELINEQLESKTLSEVIALGYVRQKDFDKAKKINDSLKDSTIKQAIEVGEKYAAGIDAFNKIANDPQQSAEKRQQAKQTVKTFEHALSTLGESNNSNS

SEQ ID NO: 8739 - protein, 76 aa, Lactobacillus casei
MASTSLEKRIKSKENRIKELEEQQKKVQQQLTAARRDLKVLKADKVDALLSESHLTYEDIATLLQKERHDEAPEFH

SEQ ID NO: 8740 - protein, 174 aa, Lactobacillus casei
MEGHRWRHWLLPLYVVLMTALMVVGWYRWSDSQSVLQETKTHLNAITGGESKKVDKRVLVFADLVVGYRADQQKRYDQIEKLSTKAIADQIVPPANIGKAGVGPDLSYKVTYQHREVTYTQAGSETIAMARVAYTITSDGNRIKNDLVLRLPMKQQRIIGCTLYRLNQSQASHD

SEQ ID NO: 8741 - protein, 825 aa, Lactobacillus casei
VANNWKDMLLNKQHHDPKDALVSSDPSRFKKALRGNKYRIQGVGGFGGKRFVRKKGQFRRGLLAQNAKHKKKQASWVKRFRHRSREALQHGAIETAKKSTVLAATNGQKSEEQNDPTYQTLSKTTQGGSRLKARLKRHRNRKGKRLAKKLGKPVQTSYSRKSVRKMMKQRALKGATFSWRHPISSIRHLLKAILMLPVVIKSMAILLLVGLVFGLIALMSSMFGWLVPTMSTTADSKPLTDAYSYITELDTDATKKVIDSMANTDGNGRSLIINGQEATTDGIELISDFDRELAYLSIKYDDFTVDDAFKQKIKKLHDQMMSVTVDSKTVTVNLSSFDEWEKNHPKALSQDDKDRLDAMGQVGQYRTQEILGSPFEDQNATIMVNDRYAWRMRGGQKNMSNHIRISSETGKKIVAVMSGTVTACSNGSVTIATDGKRTVTGGLKTVTVKPNQEIKKGDQIGTSEKNITLQLIKITQQSAPDESSSTPSSSSTLESVSQAPGLSSKNSSSASSSTVVVSSAPLPPIEEELNPAFALPNVKYTYATTYGLVTSGGNLTGQDFDANKFHAAWVKYFSNGVLVDKESYSIDAAKKAGVNPALIAAIMGTESSWGTSAAVRGANNPSGQMSGGTIIAYPSLEAGIDATRNTLHNLVVTRGLNTVQKLGAAYAPIGAINDPNNLNLNWVPNVNKLLAIFGFKSGDSIGNITLHNGGNSYPVGQCTWWAKARSGWAANNWGNGADWGSSAAAAGFSVDHTPQQGALVSFAAGQMVGNWQADPVYGHVAYVESVDSDKGTITISQGGTGFKQQPGPNLQTLGNVGAYTYIHPR

SEQ ID NO: 8742 - protein, 818 aa, Lactobacillus casei; identical to SEQ ID NO: 1665

SEQ ID NO: 8743 - protein, 123 aa, Lactobacillus casei
VALRGRVPKEIKTYKERIIGTMDLRQLICATIAFIYSAGIIYFLVWKLHWSMDSAGNVLIPLDMPVLAFGWIRPKGMPLEKYIGIILHYQQMNGLRIYENRREVSLHVHKNRGKIKEYKEDRP

SEQ ID NO: 8744 - protein, 277 aa, Lactobacillus casei; identical to SEQ ID NO: 1667

SEQ ID NO: 8745 - protein, 68 aa, Lactobacillus casei; identical to SEQ ID NO: 1668

SEQ ID NO: 8746 - protein, 633 aa, Lactobacillus casei
MDKEKAKNLVWNFGLVAIGSSAVYIVGSGLTRAVYNVQDKDAKSILDKILYVSNNLGKVSWWPPTFNGKSFLGGLILLAVVALVVLYALTNKKNYRPGEEHGSARWGTHKDILPFEDTKNPDNNLIMTATEKLYLNDLDHKRPMRLQRNQFVTVIGGAGSGKTRTVVVPNLLQRSSSYVVTDTKGQTLRWVGNFFEKSGYQIKVFDLVTRKHTDHFNVFAYINNEDDVIEVVNAIMQNTTSPQSKSDPFFDKGEKALMQALFDYLRLEAGNPDNRVVANVPNVLDLVRAATIEEDAGGNTTPLDLIFEEFKKDFPDAFGLKQYGIFKLAPAKTAMSIVISLGVRLAPFDVPSIIDITSDDTLELEKLGDEKRILFLILPDQSETFNFLVSLVYQTLFTTLVEHADHQVNGRLNETVVCWQDEFANSGQIPQFDKRINTLRSRGIFCVAIVQELSQLKERYPKSYQAILGASDSLLYLGGHDSETAQYISQILGKGTIDVQRYGESKGNNGSFNQNYDKIARDLLAPDEVDRIGGDQSIYMLRGVPPFLSQKYQLEKHPRYKELQMDHSDYVYQPQLKIENNKGGEVETEESKAESDFLANISQEETKNDAVKEKEPEADSDILADVNLLDTFR

SEQ ID NO: 8747 - protein, 158 aa, Lactobacillus casei
MDNQAAEYVLRLSTLSAQALLKALAVKLPSKAMDMSKQAIHHQRTTGKQNIAELQKKGALEHVDISKTDLRALGKKFKKYHVDFSIRRDKETGMYHVFFKGADVDRVQLVLQKVVKDFDKTPEHGQTLQEKIEKAKVTAKERNQKEKKPRQRSKERER

SEQ ID NO: 8748 - protein, 527 aa, Lactobacillus casei
MANNKKKTAAILLISAIVLGGGGYTAYQLNAAPASQSVKKSSTPSKQWRTPSKKVEQKQKNTKPSSNKPDQTIKDALAPDLPNSDKSDQTVVAFPFSKNDLSKQLESSNSQSLISLADQATAEQNTPKAADNTGTTPEPKPLTDKQTTDTKTTPSVDPSPTPNPAPEPIPEPNPTPDPNPTPTPEPNPTPDPNPTPEPNPTPTPEPNPMPDPNPTPAPVDQAPTISFADDLHLHLGQKSFNLMDGVSAHDVEDGDLTNKVVYGSTVDVNTEGTYQVTYQVTDSAGHKTSATRDVVVTNDAPVIHVSGNNQTEVGHAFDPLQGVTADDYQDGDLTTEIKVAGDVDTSKLGDYELIYTVTDKNGAVTTLKRSVTVFATAPTLDVSKVPTELKVGDQFNPKANVTAVSPYGDVIVAVDGSVDTSKPGSYELAYTATDKFGQKTVKEVTINVVADKPTLDLSKVPTKLKVGDHFDPKASVTATSSYGDVTVDVEGSVDTSKPGSYVLTYTVTDKFDQTTTQNLTVTVSETV

SEQ ID NO: 8749 - protein, 88 aa, Lactobacillus casei
MFNLVLQTKDIKEAKRHNGLLEIRFPPPKEKALMLKLRHAVLSIETGWPILPDTTCIGEIVRVLPSKERVIVAYVRPQNEFKRFVEAY

SEQ ID NO: 8750 - protein, 92 aa, Lactobacillus casei
MAEPVGIWLHDRNLKLISKDHDALSYRVRASWVKDHADYPIKPGMTVVIGNIKPPNQLKNVLVLKVVSAELKKDGSLVISGERIKSVPKNLI

SEQ ID NO: 8751 - protein, 416 aa, Lactobacillus casei
MKSMAQLEYHYGLKVRIYPSDRQKKLIKLNSDASRFVYNEMVAIGKELWQLKQVKLPIDTVQDRIKQLELRQNAKQLSNHFQFLEDKRIDSLAKANAIRNYRKAWKAFRKVHGTGVPKFHRKSYAWSYQTNCQYIQQKTTLLTNGTVCFEDGKHVLVPKLGRLRIKGSHRRLLNRKAETRIGTVTITKDAADRFFLSMQLGSDTPFMPKPAKTNRQTGIDLNTENFLTTSDGKVVANPRYYRTIKGRLAKEQRVLSRRARRAKKEHRPLRNSKNYQKQRLLVAKIHAKVLDRRKNFLHNVSTTLIKNHDLVVAEELRSKNLLKNRALAMSIADVGWRTFLGMLTYKADLYDRQFVTINPKNTTQTCHHCGFVMGTEGTNKLTLADREWTCPKCQTHHVRDHNAAQNILIKGIAKLA

SEQ ID NO: 8752 - protein, 289 aa, Lactobacillus casei
MKPTPFINAYRKAGKRADVVLIDEGHLLLTMPDPYNKFRGHNQLADILQLARVVVLVFDFHQLVKLKSFWTPALLKRVTRDYAVTHYHLTEQMRVGDAAVNDWIDHFVRGKMLPLPHPQHFDFQVFSDGQPMYDLIQRRNAETGLSRMIATADYPFTVLDGKTWYVQAGSLRLPWDKINFTDRPWAQRPETLHEVGSIYTIQGFDLNYAGVILGPSLGYDPSKDRLTVDLAQYQDKEAFKKRPDLADTTDAKAAIIMNAINILLKRAKHGLYLYAADPALRQRLLQLAK

SEQ ID NO: 8753 - protein, 153 aa, Lactobacillus casei
MTRIKNIISNQYHQLNLAERGRIESLRDLDWSIRRIAQALHRNPSTISRELKRGTTTQINASTHIFEQSYLAETGEAIYRKHRLNSCYRGLFDHCQTFCNALVTALKARPRMHSVDTFVHQFKTDHPRLVCPARMSMVRTKIVRFCRMRMVVT

SEQ ID NO: 8754 - protein, 242 aa, Lactobacillus casei; identical to SEQ ID NO: 1403

SEQ ID NO: 8755 - protein, 292 aa, Lactobacillus casei
VNPDAGKLYGISKACRMMGVSRAAYYKWTHRKVTVHEQENQAIRDYIIELEEKNHYVFGVKRLMTYINAETQYHVSHGRVRRIMRLAGIRASIRVAKRDRQVEKKAFLLVNKLYTVNMGHAFHPVAPNVVWVTDCSEITYGKDNKQRLRLSAVKDLHDHSVIAWCVAPTETADLATKTMKLAIENNDGIKPDTVHSDQGTAYTSSTYNTFLAGEGITHSMSRPGTPGDNSPMESLWSHLKIERFSFEHCLSELEMMKRIEAAINWYNNERRQETLNGMTPMTYRNHAVKKTA

SEQ ID NO: 8756 - protein, 795 aa, Lactobacillus casei
MDQTIEKTTDYSSKDYLAEVDKYWRAANYLSVGQLYLKDNPLLKRPLKASDVKVHPIGHWGTISGQNFIYAHLNRVINKYNLNMFYIEGPGHGGQVMVSNSYLDGSYSELYPKIEQNAQGLQRLFKQFSFPGGVASHADPKTPGSIHEGGELGYSILHGAGAVLDNPGLIAAVVVGDGESETGPLATSWQVNKFLNPVTDGTVLPILNLNGFKIANPTVLSRESHEELEDYFKGLGWDPHFVEGKDPAKMHVLMAAEMDKIIEEIQAIRKNAKDNDDESRPAWPMLVFRAPKGWTGPKEWDGEPIEGSFRAHQIPIPVDQGDMQHADQLVDWLKSYHPEELFNDDGTLKADIKAIIPKGDKRMAMNPVTNGGQLAKHLEKPNPSDYALDNKDHGAIEGQDMMVLGAYIRDLIKLNDKNKNFRGFGPDETLSNRLNKVFEATKRQWMEPTDPPYDALLASHGRIIDSMLSEHMDEGMLEAYTLTGRYGFFASYESFLRVVDSMLTQHFKWLRNAHEEADWRADVPSLNVIASSTAFQQDHNGYSHQDPGVISHLAEKKTKYIRAYLPADANTLVRVFDKAVDSKQLINLIVSSKHPRPQWFTDTEAKDLVEKGLGIIDWASTDQGAEPDLVIAAAGSEPTLESLAAISILHKALPDLKIRFINVVDLLKLKKDDPRGLSDDEFDMYFTKDKPVIFAYHGYDDLIKDIFFDRHNHNLHVHGYREEGDITTPFDMRVRNDLDRFHLVKEAVLDVPDFTEKGAHLMQEMDDLLQKHHDFIREAGTDLPEVEEWKWEPLK

SEQ ID NO: 8757 - protein, 253 aa, Lactobacillus casei
VNYIERQQSILKQLNSNGSVRISELAKDLSVSRETLRKDIAELGNQGKLQVIRGGAVLNKPVNETIYDQRRKENFQEKLSIARNAVKLISEGDSVFLGNGTTAALVAQEIKEHEFKNVVVITTSINVLLELRYAESVQLVLLGGGLRRIEGSLSGPLTLANIDSVFCDIGFFGSGGVSISRGVTNHYFSEIEVDKKMMQHCHKKVLLADHSKFTKMNPFRTASISDYDVILSDKGLNTETISAMEKHGVKVIV

SEQ ID NO: 8758 - protein, 363 aa, Lactobacillus casei
MLNNAVRSKEITSKSYRLLKPGDIEEVMLKHELKPGFVNIQPLMASVCHADDRYFAGKRRPEALAKKLPMALLHEGIGTIKETMSDKFQKGQRVVIVPNVPGYMLRGEKKKDTIPDNYSVDSVFLSSGYDGIAQSDLVQPDRAVVPLPDNIPDEIAILTEVSTVGYHATSHVADALAKPDCRVALFGDGPVGYMAAAVLHYIRGIDKEHLTVFGAVPDRLNEFDFANKELVTEYDFDHAGEQFDVIFEATGGNFSSSAINEGIKVIKRTGKFVLMGVSEDLVPIDTRDILEKGLTFYGTSRSTTPDFEEVVKAMSQSQAYQDTLRKLLPKKETIIRSASDLNKAFEAIVASKAWYKAVLKFEW

SEQ ID NO: 8759 - protein, 155 aa, Lactobacillus casei
EIIABCMPNENTMVGFVIATHGKLASGFLDAVKLIIGEQENIGEIGLFEGNDVSEFGLKLEKLIRQEDEGDGVIVFTDLFAASPYNQAALCASRIKNVKIQLITGVNLPMIIEAINARMMGQNIEQITNAAFETAKVGIKNFWDELNAHNSHTKH

SEQ ID NO: 8760 - protein, 158 aa, Lactobacillus casei
MSQIVLARVDDRLIHGQVMTAWLQYTEGNHIVIIDDATAKDDFLKSIMSMSVPQGIKLDVLSVAEGPDFLKEEHGNDKLLLLAKTPKAFLDLVNAGVKIDKVVIGGMGANPQRKKFYKNISASDDEKAIMQKLIDAGVDVKIQIVPSDGATDVKNLLK

SEQ ID NO: 8761 - protein, 253 aa, Lactobacillus casei
MTIHLWQAFLIGVVYYLGQMGTPWVSLAGTHTIMRPLVNGALVGLILGDPVKGTIYGAAIQLPFLAWIGAGGAVPMDTALAGTLGTALGMASNVSPSVAITLAVPISLVGTMIWVLHMTVDITFVHMADKAAEEGNLKRIDFLHVWPPQITMFLFSVIPAMLAAYFGAGPVKQVIGGLAGTPLHVLTVIGGILPALGIAMNLHAMSSKGTIVFFLLGFMVAVYSKLAILPIAIFAAIIAYIYTQLFLKRGEQA

SEQ ID NO: 8762 - protein, 292 aa, Lactobacillus casei
MSEEDKKEQLEEKELPSEKKPNAKRLSKRDVVKAFWRWTFFSHANYNYERLQATGVIHALSPIFKKLYGDDEAEMKAALLRHMQFFNTEPHFGGSILGVTIAMEEQKANGAPITDETINGLKTGLMGPLAGIGDTLWQGTLIPILLSFTISFAAKGNILMGPVLFAVLHLAIIWSIGYLAWMQGYNLGKEGIAKILQGSLLPTVMTYAQTLGPIVIGALSATFVKISTPAKLHLGKTVMKVQTGILDKLVLGLLPMAVTLLTYYLLRKKFKPTTVLLILVGIGVVGGLFWII

SEQ ID NO: 8763 - protein, 219 aa, Lactobacillus casei
MSIEIAPSILSANFSNLMQDIDKVKDSGIHMLHVDVMDGHFVPNITFGSKMIADLHKSTSLKLDCHLMIDNPDKFAPEFARAGGDVIMVHLEASVHIYRVLQEIKNFGAKAGLVLNPGTPVDAAREVLPLVDQVLIMTVNPGFGGQKFIPQMVNKVQELAELRDNLGLKFNIEVDGGINDITIKDCAAAGANIFVAGSYVFDASDPISQVNKLLTAVGQ

SEQ ID NO: 8764 - protein, 193 aa, Lactobacillus casei
LPYDVHGGDFVIFDTSMVIPSLINGRDLNYALRVPSKVILLSGVSIGNLREFVYAIHEHQKQAVAHIDILGGFKSDDIGMHLLKNLYKLDGILSANVRALSQGKHWGMTTIYRLPLIDSLSLAKANDFLKNSDSYDAVQVLPAVGAIAEVKRIKQMVTHKPLIASGLLETRNQVKLAFSSGYQLIATSQKDLW

SEQ ID NO: 8765 - protein, 272 aa, Lactobacillus casei
MSKFRRMNQIFAADGRAVVAALDGFAFSMTTSGIDDTSLQIDQLVDAGLDTALVTYGQAKTYEHELSKVTTVLRVDANTEIYDSSVPNTQLFFDIKDALKLGASGVVCMTFPGASKREADSHHMLTKLAHQSAKWKVPVIAEALPFGYPVTSPKSNDPYYIATAVRLSAELGADIIKTRFTGTEEDALITGSTSQPVLALGGPKTDTLTYFKFVQHCIEIGARGVAVGRNITQSQSPVGIVAGLNAIVHNNADANTAFEIFKNYEKKNKKEG

SEQ ID NO: 8766 - protein, 354 aa, Lactobacillus casei
MATMNAAIFNDIEQLDVERINKPNIKEDEVLVEIKACALCTWEQRVYTGVNKVHFPFIGGHEEAGIIIDVGKKVDTDLWQIGNRVVVGLLTSCGYCDNCRTGHEGSCTQFSYENHVGGLNIRGMGGLAEYLAVPVTKLFKIGDQLTYEEAALTEPLSCVVHSVDTAKVELGNDVVVIGAGIMGIFHAMLARERGARVIVSEPDGNRQKFLKQLGFHEIINPKHLDPVNAINTLTNGKGADVVFDTLPISPVAEQAVSMAAIDGRVILYSSFHPDMPISISPHTLHRRMTKLMGSANSDSGDFLKAMKLLNNGSVDVKPLIAGTVPLSEIDKGMQWALKPETYRVIVELNRNDDK

SEQ ID NO: 8767 - protein, 242 aa, Lactobacillus casei
MLESLKKQVYDANMQLPKLGLVTFTWGNVSGIDREKGLFVIKPSGVAYEDLTPDDMVVVNLQGEVVEGDLNPSSDTPTHTVLYNEFPDIGGIVHTHSPWAVAFASAHMDVPNLNTTAADTFYGDVPVSEALTKQEIEEAYEENTGKVIVKTFKDRGIDHNAVPAVIVSQHGPFSWGATPEKAVYNAKVLEVVADIDYHALTLTHADVHVPQYLLDKHYYRKHGKNAYYGQNNAKSKSHAVKL

SEQ ID NO: 8768 - protein, 356 aa, Lactobacillus casei
MVNTMKAAVLISAGNVEYKDVPVPEISDDDFLIKVAYSGVCGSDLPRSQKENGARLYPLIMGHEFSGTVEKMGANIEGFKEGDHVAIAPLLPNPDSIYTKMGLYGFSEHYNLIGTGSNGGFAEYVKVPKGHVLHLPDSVDLKTAAGIEPATVSGYGLARGHIQAGDTVAILGAGSIGQFAIQNAKLYGASNVIAVDVFDDKLELAKKLGADYTINGKTQDVIAEVKKITKHGVDVAVDCAGSRFTEIEALEITRRDGNVVYIGISGDDLPIPKDVFEQYVLRGGLNIHGSWMSYTMPYPGRAWDIVIDAMSKGRLDFKSMISHEISLDQLGDTLKKMYNKEIEFNKVVVKINQDID

SEQ ID NO: 8769 - protein, 480 aa, Lactobacillus casei
MLTTVKLVFDTFGANVFVPIILFFIALILKVKTQKAFLSALYAGVGLTGFTLLLNSYTPIISKVIKKMVSDTGVNLPVFDIGWQGASLVAYSTQAGMIFLVVAFILQTVLFLVRWTDVFQPSDLWNNYSYMVWGSMCYYVTKNMWLSLLLMCLLNMYSLLLSDSIAQRWSTYYGYPRTTIIALHNLEPAIFGILMDPIWNKLHINKIKLSPEYLQEKLGFLGEPISLGFFLGFLLGILGNFKHLGELASWGQITQVAIATSAIMAIFPKIAGIFAQAFAPLSQAASRSIRKSNKGKAANQPEGKKPRLWFLGVNDAVGFGETATLITGILLIPIMVVLAILLPGNKVLPVIDLLAIPYWIEGLIALSNGNMVKTMINAVIWFSLGLYMCTATAPLFTHIASSGIGVAIPTAALMVTSFNILGKPFFGLIFYAFLSQNIFWIGLTIVLYFVLWAAFQKNKEKFRAYLERAAAKNATAATDD

SEQ ID NO: 8770 - protein, 103 aa, Lactobacillus casei
MTKRINLLAVCGSGTVTSSMVAGEIQDELSDDGYTVKATEARPTEAKQLIDSGKFDLVVYTSPLPKADYGVPVINGTGLLTGIGEDEFWEELKKTVAGISAKA

SEQ ID NO: 8771 - protein, 172 aa, Lactobacillus casei
EIIBCACMPNENTMALKFEEAFIYPKLDAKSYEDAVRKMSQNLLKEGYVTSEYPDQVLAREKNFPTGLVLANMNIGIPHTEAEYVKKTAVAVATLREPVKVHSMIDPEQELPVSMMFMIAVSDPKGQVTILRELMRLFQDQDLMEKIMSEDTASGIYKLLKSNTVKEQSSKS

SEQ ID NO: 8772 - protein, 160 aa, Lactobacillus casei
MTYIQTKRNGWCYLSTIMDLHSRRIIGYSFSKKMDTDLVLKTLESAVKNRTITGDLIIHTDLGSQYTSDDYNQRLTELHIRHSYSRKGCPYDNAPMESFHASLKKECVYPVPVFEDYETAAAVLFEYVHAFYNRKRIHSSLGYQTPLQVEIATLTSQMAA

SEQ ID NO: 8773 - protein, 180 aa, Lactobacillus casei
MRWVHHYGPIFKALWRRHQTAHAKSWRIDETYIRVKGRWAYLYRAIDSNGLTMDFELRKHRDYTASYHFLKRLLTTNGRPDRLVTDQYRATLKAVKHLIKQDYLSKSAHQCSKYRNNLIEQDHRFIKRHRVRSASFQSIRTASATLSGVEIVHAIRKRTRRELSLIGFSVVDELEALLAA

SEQ ID NO: 8774 - protein, 456 aa, Lactobacillus casei
LQSRINNFAKGDDGMKSTTKWVTRWPERISYGLSDAADNLVFQMMTTYLLFFYTDVYGLTPSAVAILFVVARVADVVESFVIGIMIDHTHSRFGKSRPFFLWYSLPYVIFAVLTFVTPNFSYNGKLIWAYVTYLGLGFLYTAVNLPITSILPTMSQNTRELTLLGVIRQFFGSSVQIVVAVFTLPLVAFFGHGNQQKGFLGTIFVFSLISFLLIINTFVHVRERFANPEIAHQPLTTVLKMLKHNQPWIVMSIVILMYWLVTAIKNQTTIYYFKYTVGNENLVPLANSFTLAALIGVLLIIRITEVRSKKQTMLRGILMALVGQAVIAVGVYTKILWFLFGGVLINSIGNGIIIGLVSIMIADTIRYGASMGIQAEGILASTDDFGVNVGLGVGGLITAGLFHFSGYVANRTQNAATLTMINLNYVWIPLVIYVGMYFVLRLYDEGRIERAIEARK

SEQ ID NO: 8775 - protein, 306 aa, Lactobacillus casei
MAIITLIERSQIELMQHHTIQYIAATLGRSRISIRHELHRCPEGDYCAIIAQDHADTCRHRCGRHSILTPKLKRMVTEKLNLGWSPEMVGYAVHCAPHTIYHWIYQRQVDFQPSQLFDHGKRHKRRQDLRSRYNQAVGTSIEIRSESANRRTEKGHLEMDTVRGGRGSKAAVLTIVDRVTRLMATTKLENLSQNAVLKGFARLMVDFPGPVRSVTVDHGKEFSCDQALTKRYRIPVYFCHAYHPNERGTNERFNRELRYYFPKGTQFDQVSETDIQQATALINNKPRKCLRWQTPVQAVSKPLSRW

SEQ ID NO: 8776 - protein, 275 aa, Lactobacillus casei
MKRTQRVVHLFIILAGLFLVLVGCQKTSSQQASSSTSNVKQELLDHKTLTVGLEGTYAPFSYRKNGELAGFEVDLSRDIAKKLGVKVKFVPTKWDSLIAGLGANKFDVVLNNITKTPEREKVYDFSTPYIYSRYALITPTAKAGTITKLADIKGKTVVEGTGTSNEVLAKKLGAAKILPSGDFATTLGLLRQNRADATINSTAAWYSFVKSNSTKGLKFRAVPDSQQKPDEVSALLTKKTPKLRKAVNQAIHDLRADGTLKKLSEKYFGGDVTTK

SEQ ID NO: 8777 - protein, 381 aa, Lactobacillus casei
MTDFNTKLVHGIPVGDNQTGAVVPPIYQSTTFAYPQADAKVRWDYTRSGNPTREYLEKEIAYLEDGDAGFAFSSGLAAISTVFSIFDRDDHIIIGDSVYGGTYRLLNDYFTKHGLSFTTVDTRDLDAIKGAIQPNTRAIYFETLSNPLLKVTSVKKVSALAKEHGLLTIVDNTFLTPYLQQPLNLGADIVIHSATKYLGGHSDVLAGLVVTRTPALSQQVGYLQNALGPTLAPEAANLVRRGIETLSLRMDREQQNALAIAEHLEASPLVSSVHYPGLKQDPNYQIAQEELNGAGGVLSFELADNVDADRFVNQLKLFTLAVSLGSVASLAELPWTMTHAELPVSARKASGLSPQLIRLAIGVESVRDLIEDLDQALAQMG

SEQ ID NO: 8778 - protein, 86 aa, Lactobacillus casei
MQPVTITNLDRLLTALIQARQRGEVQQTVVERVPSEPGADHIFGIRTDQGEFKPLIRFRFDQKLPDNYAEALKQHGYRLEVLHGKH

SEQ ID NO: 8779 - protein, 1551 aa, Lactobacillus casei
PIIITYPEPRTEINASEPRECRSRMNKNSTTEMKRHYKMYKAGSKWMTAAIITFGTSLIVLGGTATQSVAADTTTTPTEKTSQTAQSTSTQAQPAAQTTTSQATASAASSNATQTTTANNAKSSAAQTQATPAQNTQSSASQPQTTSQQASSATAKTTAPASGATTQTNTSSTASQTATSTATTTTSQASAAATATSTTTADNQNQASSAATTDPGPANQDTLTKGNVKGLWDEGYQGQGMVVAVIDSGVQPHADLRLSDDSTATLTKEKAEAAIAKLGYGTYVNSKIPFAYDYVNNDSVNTGTTVAGSTHGEHVAGIIAANGTTADGATGKEKASTYVKGVAPEAQILAMQVIDEFPDENANDISRAIRDAVALGANAIQMSLGIGVTEQDLTDEEQAAVQYATEHGVFVSISAGNNAIAGSIIGSKTPNDISTAYAPKNDSTIGDPGAAASAMTVAAETSATGADSQMDGFSSWGPMADYTLKPDISAPGDNVTSTAIDPTTNTQTYAVESGTSMAGPFNAGAALLVMQKIKATQPDLTGADLVKAVKLALMNAAEPMKDVNYPDTYISPRRQGAGQIDVAKAGDLTVSAEGTNDAGSVSLGKVGKTTTFTVTLTNHGKTAQNYTVDTNGGPLTQVRDASNGNTVHDEILVGATVNTDTANFTLAAGETKQVTFKLSLDDSVAANQLVEGYLTFKATDAAQTISVPYLGYYGDLTDEQVIDAPANSGESIFNGGYLVDNNNNPLGVTDAASLSNLVNTDTTGKYTWTLVPTYVDNKKVSFSPNGDGASDTVFPYVFSKQNLKSVTIQILDAQGHVVRVLDKENNTSKSYLQNGNSFNSDLGLSTDMRLDPNAFTWDGKVYDQATGKYVTAPDGKYTYRLVTEQYNTGAQQNQDYDLPVTVDTVAPTLTGLSYQDGRVTVHYDDQGAGFTKFSDLALKIGNKAYGVNLNNNGQNNDGTLNFELTAAQKAALENSDGSLTLTLTDVAGNKTSATLQATAGTHQTDTTTPTSDVAPQFTWKVGDGPHNFWRSEGFVQAVSDQTSFTAYAQVPAGVDWIVYATDAQTGKVFPGTVDTKTGTVTFNLTESAPYGDFIGTVLSPTADFGTYEEAGRADGDEMIVFLDANGTAGYGHFSQKNVHVVVPLQDNAKAAANATKTSGAPVLGGRAFSQITTHAQPTAGLKFDKFNDNSFTLVGADQVADIYNAQTGQLTITGHVDNPAGKTLTVTDATEPAKTVTIGADGKFSFTVPFKAAEQQSVGYRLTEPATDGSKSTKTAYGELQIYLDTIFPTLDLPQADTLKVDDQGNYDITTTSDTFTVSGTVNDNINGYRLYTNGDNVVHQKNLAGFNNHLDPLSTTSNPYGAADFNQTYTLKDGDNYFTVTAVDMVGNKVTKVFHVVKVKTPTPTPGDNDNNGNNSGNGNSNQQGIGGNQGGNAGNQGNNGGTQGGNGSGQNPATGNGTPTTPTTGTGSNGGNGNNGQQGPKLVTLDNKLKDQTKTPAAKNGTTANATKQAATGKTMPQAGEAQSPLAVFGLAIVSIFSFMGFASRKKRV

SEQ ID NO: 8780 - protein, 356 aa, Lactobacillus casei
MVKKTINNVTREKWILSTFPEWGTWLNEEIAAKHVKSGTFSMWWLGCTGIWLKTAEDTNILVDLWCGTGKQTHGSGMMRKGHQMMRMSGVQQMQPNLRNQPFVIDPFAMKDVDALFVSHIHSDHLDINTAAAVNANCPNAKFYGPEKVCEIWQGWGVPTEKTVVVRPGDVVTIGKTKVKVLEGFDRTALITEDDPNVKLAGKMPQDMNQIAVNYLFETTGGNLYHAADSHYSNLFAKHGNENHVDVALGAYGENPRGITDKVTSIDILRMAESLKTKVVIPVHYDIWTNFMADPKEIEALWQMRKDRLQYQFKPFIWQVGGEFTFPDDKDRMEFMYDRGFHDTFSVPNDTPFPAFL

SEQ ID NO: 8781 - protein, 152 aa, Lactobacillus casei
MLLKDFWEKDLVDIRPEPATDWRDALRQAANKLIEHQYILPGYVNEIIGNVEKNGPYIVIVPGVAMPHAMAESTNVLGTAIGFAKFPEPVIFDPDDPEKQAQLFFTLAAKEPNQHLQNIGDLSDMLMTEGLIDRLLAVESVDDFKVIVDAES

SEQ ID NO: 8782 - protein, 505 aa, Lactobacillus casei
MQPFLDFLVSVWDYFAANILTQPAYMIGFIVLLGYILERKPLYESIAGFLKAVIGYMILMVGSGGLVNSFRPILTGLKDRFNLTATVIDPYFGQNAVTEGLEKTFGRTFGDVMLLLLFAFVFNILLVRFQKWTKLRAVFTTGNVQVQQAATAFWILLFCFPQMGRIEVLVVMGVVLGLYWAVGSNMTVRYTQDLTDGGGFAVAHQQMFGIAFVSWLADKFKAHEVKAQKKARRLEDIELPGFLKIFNENMVATGILMLFFFGIIMLILGRPYFNGVFAATKGASGLAPNGSFLFYIMTTSLGFAVNLTILQLGVRTFVGELTESFTGISDRLLPGSVPGIDVAATFAFGEPNAVTIGFLFGALGQFLAIGALLLFHSPTIIIAGFIPLFFDNAAFGVFANRRSGAKAAMILPFLSGLIQVFGAALIATWIGLSKFGGYLGMFDWDTVWPFFTVLMKFLGIVGIVAVVIILILIPQLEYRHDPKNYFLMVTDYEQYKENMTKKKAS

SEQ ID NO: 8783 - protein, 97 aa, Lactobacillus casei
MNILVSCANGSGTSLMMMRSVQKAFKRLNIPISKIEHTNLAEGKSTAKQYDMVFTTTNFVDMFKDAKDKGVQVIGVKNVMSDKEVEQRVREETDLVE

SEQ ID NO: 8784 - protein, 213 aa, Lactobacillus casei
LTKPNLQVALDNNTLASALADVREVGPLVDIVEAGTILILQEGTIAVKALRALFPEKVVIADTKCADAGSTVAKNMADAGADWMTCICSATIPTIQAAQQEVADIQIELYGQWTKEDAQLWLDIGVTQAIYHQSRDALLSGGSWGAADLAKVQMLVDMGFRVSVTGGLSVDTLKLFSGVNVYTFIAGRAITQAPDPAKAAADFQAEIVRIWGK

SEQ ID NO: 8785 - protein, 260 aa, Lactobacillus casei
VTMVKNSMANVQARREKVLVVVDQAESVAVEELARQFDVSITTLRRDLKALSDMGQVKWHHGLVEKAKLPTTANHTSRSGIELLKDTIAETVPGYIVKNSTLFVNSSSLCWRAINQLATMPLTIITNNIRATECVRHPETSIILTGGEIRYPKESLVGTVAIQILETMQSDFTLIGCDGISEGGGVTTQNIFEAQVNTTMIARTKQKVICVADYRKVGVTSNYHVADLTAVDVLITDNFANEKTVRELRRHGIDVVQVVN

SEQ ID NO: 8786 - protein, 295 aa, Lactobacillus casei
LNSLGIYEKALPKTDSWLTRLQLVRDLGFNFLELSIDESDERLARLDWTKDERAAVRDACWQTGVRIHTLMLSGHRRYPLGSADPAVQQKSCDMLGKAIDLASDLGIRNVQLAGYDVYYEPKTIMSRECFIENLQRGVAYAATREVTLAIETMDDPFLNSLTKIRALKDQIRSPWLQAYPDVGNLSAWPENDVGRELELGIANIASVHLKDTQAVTADHPGQFRDVLFGDGVVDFAGCLRTLKRLHYGGAFTIEMWTEKAADPIKEVKQAKAFFDKLFAQVGLTQEPVSEANVRS

SEQ ID NO: 8787 - protein, 273 aa, Lactobacillus casei
MLKAIALDMDNTLLNSKKELSVTNRDVLRYLNRKGIRIILCSGRPFATLKPFLEELHVTKNDDVCVCFNGGLVRLVREHTVIKETALTKEQVKPVYDLVKENGFKLDIVGEDKVYSLTEFGKLSYQTLIPKLMPFTDTTFDKVPAKLPIFKVVIAGEPDMVDAAATAAKSLKNLNVARSRRTLLEIMPENVNKMNGLKAALNFYRIPREQLAAFGDEENDKDMIEYAGIGVAMGNAIPSIKKIADITVPSNDDDGVASYLVDYFQISPTAIRL

SEQ ID NO: 8788 - protein, 242 aa, Lactobacillus casei
MLEQLKQDVYEANMQLPKLNLVTFTWGNVSGIDRERGLFVIKPSGVAYEDLKPADMVVVNLDGEVVEGALNPSSDTPTHTVLYNAFPDIGGIVHTHSPWAVAFASAHMDVPNLNTTAADTFYGNIPVSEALSQQEIEDAYEENTGKVIVKTFHDRGLDYKAVPAVLVSQHGPFSWGATPAKAVYNAKVLEVVAEIDYHALTLTHHDAHLPQYLLDKHYYRKHGANAYYGQDGAKSQEHAAKA

SEQ ID NO: 8789 - protein, 612 aa, Lactobacillus casei
MTLSSRQRQLVLQLLNAEGAVTAKQLAESAGVSVRTVKYDLADIRDWLAAKGSALKSAPRKGIWIEAGDAARAALREKIDEQIADHYLAPNERIIRMILILAQTGDYTTQQQFQARVNVSQTTVNNDLKKLAVYLQQFNVKLTSKNYYGYKLNGTELDIRRLLEQLITQQLNRKTLMAELVDSLSTKSEPKRAVILTGEATFDHAFNTILKEAIRLGKTEAHMPDPSELIATIIRLTIGVIRQGFNQLVNSYHRVAQSHAKQHFTDKLIMNTLAFYNLPALTDDIAYYLGQRDHDQPAAQDHNLVAMTHRIILAVGALVDHDFSHDSQLQENLYLHLSQSLGKHSQLLEYSPFTQDIKQEYPGLFAAIEKTVNKELANDQAVLSEAFVSFIALHFMVSLNRDSQMRTVRVAYVCATGIGITNLIQQRIASAIPNIELVGFASIDDARALIAREQPELVISVFPLKNVDVQVIEVQPLPNATDIAAIRQAVAKKLQVPLAQIKSQHSVVPIKPKPNLEQQTQQTILTMFSIYSELKLQLPTKIDPYYGDAFMMHVFLAVQRIMFNKQYQGKPNHDDPKLVGTVEHVFSDHGLAINRAEVHAILEYLSLSHATS

SEQ ID NO: 8790 - protein, 125 aa, Lactobacillus casei
MQHLRKGMTPLEANDELPEEVQTMIQQSSDAQAAEALVRYVIGLAAAAEIRFTDVQLQVLTNHLIEMLNRSQSGEQLPAVDPQMFADVSQKSLDLADQVVRHIGHLAVAEKYILSIHFEAAQNKI

SEQ ID NO: 8791 - protein, 119 aa, Lactobacillus casei
MVKVVIADRMGKGQNVAKGVEAAGGTAVVVPGMGADMRLGQVMDKEKADMGISFCGSGGAGAITAHTQFGWPERHGMRSIQEGVTAIEEGTKVLGFGFMDQEALGKALVEAWNKKYPEA

SEQ ID NO: 8792 - protein, 122 aa, Lactobacillus casei
MTVVNETKRQVVTVSGKGETKQQAFAAAFSSIQKQLVGNGDEAILRIIPEKVEPLKLVKSSYTEKFLFFFFKRTRTTYAVTLAVTVAVSAIDLDALTFEDVTTPSPDALSLPNLKNMLKGVK

SEQ ID NO: 8793 - protein, 259 aa, Lactobacillus casei
LPILTILFQSIIIGGLVGFAAGVGAARMFTAPKTQALGAFRTLGEMNAAEGDPASHFSFGLGFFFNAWASTVGAGAFTQDITHRVIPNWAAAGLLMKNRNVEQTMHNPKKMGIAGAIVGAVVVVFLNVTSSSIPESLQVTAVKVLVPAANQLINLIMPILFWLAAIDAGRRSGLFGTVFGGLSAMIMGNAVPGVVLGILIGKGVDELGWTRITKSILAAAILLFVLSGFFRGFDLNLLKSFNLNAPGWLSNVHQMIGGK

SEQ ID NO: 8794 - protein, 229 aa, Lactobacillus casei
MADKQTTATADEELKAVANEHDFWHADWGFVVIVALMSAGVFAGTSMYFNYGVGAFNEVAIVAMLKAGMTGGSYGAAAAFGASFLFARILEGSLVGILDLGGSILTGVGIGIPAILLSVGAKPLVANFGLALLTGAVLGIIIGVIIFLVRKFTINQSNATFGADVMMGAGNQTGRFLGPLIILSAVTASIPIGIGSTIGAALFYAWKKPIPGGAIIGAMIMGFFFPVKL

SEQ ID NO: 8795 - protein, 373 aa, Lactobacillus casei
VFDVLIKNGKTEREQPIEVGINGNRIAAIAPKLEGASGQKEIDLHGQSYVSAGWIDDHVHCYEKLALYYDDPDADGYKSGVTTVIDAGSTGADNIRDFYNITRDKKTNVFALINIGRTGILAQDELGDMEKVSKEALFDAVVDLPDFIVGIKARESHSVVIDNDIKPLLAARSYAALLGHLPIMVHVGANPPELQDILQAMGAGDVLTHAYNGKPNGMIDENGEIKDFVYDAYDRGVVFDVGHGTDSFNFKTMKIARDHGLDPKSLSTDIYHRNRENGPVYDMATTMEKMLQVGYTLPEVIRMVTFAPADTFHLLNKGRLRPGKDADITIYNVTTGDKVLTDSNGNTETGHQLITPICTIVGGTVYDLEAQRA

SEQ ID NO: 8796 - protein, 366 aa, Lactobacillus casei
MTDYYSTYDLKHVINASGKMTILGVSKVPEAAIQAQQFGDTHFFEMKDLTDKTGAFIAKKLGTEGALVVNSASAGIAEAVAGIIGRGSKYHAYHPFSPRYTKREIILPKGQNVDYGTPEEVMIELGGGQVVEAGYANMCTPEHVEMMINENTAAIFYVKSHHAVQKSMLTIQEALEVAHKHELPLILDAAAEEDLKKYVDMGVDVVLFSGAKAIEGPASGLVFGKEPYISWTKLQGLGIGRAMKIGKENILGFTTALVQYLDHGPESGEAMKARLHPFVAALNDVPHLNVKEVQDGAGRPIFRAAVTVEASSPKDAKQVTAELKAGNPAIYTREYRANEGIIEFDIRAVDQAEMDLIVHRLKEILA

SEQ ID NO: 8797 - protein, 253 aa, Lactobacillus casei
MNLIPNYYKNRVALNVLAGSVENAKEIYEAAEGHVVVGVLTKNYDTDEAAIEDMKKYQEVTDNGLSVGLGAGDPNQSTMVSRVSKVLQPQHVNQVFTGVGTSRALLGQADTVINGLVSPTGKVGVVNIATGPKSSQKAAAEVPVETAIALLQDMGGTSFKFFPMGGLKHEAEFRAVAQACAAEGFNLEPTGGIDLDNFEAILQIALDAGVKQIIPHVYSSIIDKATGLTRPEDVAALWRITKRLVDASELVAE

SEQ ID NO: 8798 - protein, 70 aa, Lactobacillus casei
MYSMLSGRLKNDSGSAIASAGPIMVRDTISSWIAEVITKAIITVAAAAIVAIVKYAYKSAARRLRKRKKR

SEQ ID NO: 8799 - protein, 95 aa, Lactobacillus casei
MTNEWHVIPHRDVKRKDELLLQKANLFEKYMDIIKTLKENPFSRKYHHEMLQPKAEKIYSMRINSKHRVVYTVDKKAHLIKIWSAWSHYEQRKPT

SEQ ID NO: 8800 - protein, 85 aa, Lactobacillus casei
MEVYTPTNLRKNLFDLLNKIVDKNEEMEVTLKQPKGPNKGVILISKDRYEKLEELDFLQRTGTLDVVMQRMENEKPGDFNEKNAY

SEQ ID NO: 8801 - protein, 480 aa, Lactobacillus casei
MDNAIINKDILLNLSVEDGGFDFSTSIADAMAKAETELVVLNETVDSIKGLKPDCDKLDYILATSSGALCGIIDIFLVGKPGESPLGNITDKWFVARMIDFAKLCNPEKKNFDSLDSALRFLEKKFKVPYDQTGLGDAGKTIFDLTAKNHHFKSLAHNPSLLGLFFSILDQFSNTSHFVTDGQLVSLQQADEKWELRGGNIPSKLFCGFANWIGHLISDVSGSSSSAAKGNRGTGLPSPLWTWTNDIIAIKAKLGLSVTETDKAMNELALNIFEKGYDIRFQTAQAIPVFLNELLVRLIYAIRRLFRYFSEIPKTERSFALMWKKCEPFSNATVKRMLTVAHGTFCLVDVGDAVGRSLIAGGGTFNAVEFVLRLNVVGVGRFAISLYGETRRAISYNHAKKEFDFASKETVIVSNYIEGLKILAHQYDDHHLLMFISDFEKSDAYIEAFGKSVTLAEVRNVPVNRILKSKPDIDKYFGGK

SEQ ID NO: 8802 - protein, 369 aa, Lactobacillus casei
MAKKSSKLKKAQQKAKAAAQKTNQKINELGKYTSSLYTSLTTIQSLFDRIRNVPEKNMLKYEKLKTIRVNWKQQAEKIELEYKKAEVKATGQGVAGVGAGVAVAALGPTAAMGIATTFGAASTGTAISALSGAAFTNAALAWLGGGALATGGGGMAAGSAFLALAGPVGWTIAGVSIVASGLMFFKTNSDKERLENTYTLISNRDIKSYELAIVELSKRITRIIDESEKLREAIVKIETFGTDYTKMTEAQQYELGAYVNLMEASTALLVNPILGLQPKYSEQDFDKLCASESELYRRYFKTHKTMIISMANLLYKIKLDDKDKKLLAKSLKKNKDFLSSVQMAKKKFDAADISMIERALNYRYKYSTY

SEQ ID NO: 8803 - protein, 132 aa, Lactobacillus casei
MNWQKIWAVNKYWVMSKSQQQYDHIRLLAKNNQWTPQKSQELDKILDSLGSVSPTRKTLVTTYQHIWGYFKKKCTDEELHQYLKLLDELQPDNDSLGPFLVQLTAKYQIDYLQKSRLIIELNEREGQSISKN

SEQ ID NO: 8804 - protein, 161 aa, Lactobacillus casei
MKVINISGNQDTGKTTLLQTLRKKVKLSCNDSKEKPTNHESDFVGIYHCSAKDGDYWIAIISEGDSAWAILKNLEILGEILREEESVSPADIRYLFYTSHNPQKETQNKIDSKIEELAGTDTDRYFYATTKIHENDSSEVVNEQKERQLKLILTDIGLRIN

SEQ ID NO: 8805 - protein, 251 aa, Lactobacillus casei
MKIDERRRYILDAVNQNKNVRISALSKKMAVSRETIRKDIYNLAEKGLVSAIRGGAEAVDDDPTSRFDQRKAVNQDAKREMAQRALSYIKDGATIFLDSGTSSYELAEALKQEPRHDLSIITSSTFVAQTLLVMKGIQIVLLGGVVRGDEGSVSGPIALQAIESIYADVGFFGCGGIDEVSGITNRYLEESQTAKAMKQHCRTSIVLADHSKFGASSLVSMFKLDDVDFIISDSGINKDLVQHIGVKNLVV

SEQ ID NO: 8806 - protein, 107 aa, Lactobacillus casei
MSKRINLLSVCGSGTVTSSMIAGEITDNLKSDGYHVNATEARPTEAKQLVDSGHYDLIVFTSPLPKADYGIPVINGTGLLTGIGEDEFWDELKSTLAKLETDKTNKV

SEQ ID NO: 8807 - protein, 193 aa, Lactobacillus casei
LTTEKQKFLAGQPYRIFDEELAADEERARALCREINRCTTDDAHKIGLIRQLFGSVGKNVYVQPDFHCDFGYNIHVGDNFICNYNNVMLDIAPITIGDDCMFGPLVQLYSASHPLDPERRRERIGEGSPITIGNNVWIGGGAVVLPGVSIGDNTVIGANATVTHSFGANLVVAGNPARVIKQIPQKDGSSSAS

SEQ ID NO: 8808 - protein, 193 aa, Lactobacillus casei
MLVPYTTKKLYYAYPIFIIGYQDDRCRYNVTTCSSSYSLGDMFTFSVANDENVARQLQRTRHCTINYMTSAHLDQIEYAGYLHRREKLNSGQLPHQIDPQTDLPILTDALSTLFIDIEKSVPYHGYINFIGHITRRLVQEDALQNGRLNVATITPALYAGDHHQRVYREVNQQVKTTGQFFRQRTQLNKHHEG

SEQ ID NO: 8809 - protein, 239 aa, Lactobacillus casei
MACSEDRIVAAPNVTDLAAMLADNTRSAIIDVLMDGKAYTLSEITQRLTVTPQTVSYHLHRMWAIGVVNQIKSGRHHYYRLASNELAATFESLSTVAPRQIEHRLSQRQSATAMTYCRSCYDHLAGKVAVSLLHALEERHFVMAHSNHRLEVLSAGKDFLKAELAIDPDSIDRTRRQNTVACLDWSERDFHLGGAWGHALFKGLLANDYVQQTPNSRIVTVTADGRQWFASKLALQLHA

SEQ ID NO: 8810 - protein, 305 aa, Lactobacillus casei
MKQYLAIDVGGTTTKYALVSDQGDLSEQGKQATVHSNLTDFAQAINQLIKRYQTQIAGIGLALPGVVDPQRGIVKACAVLPFLENVALTTRLADAAVVTVPVVLENDGNAAALAEFWRGQLAGTTNSAMVVLGTGVGASLFINGQLYTGSHQVGGEPSFMVTNGLRPITRDQTAAGLSAVKTVNAMAAALNIHRTPLGPRVFQALKPNTPAAAILEIFTRGVAAMIYNMQTVLDLEKVVIGGGISAQPRVIAAIQSGVAAYRDVTPLAARTIQMPVIEAAKYHNEANLIGAVVPLLQRTGIHSKS

SEQ ID NO: 8811 - protein, 320 aa, Lactobacillus casei
LNKTTWGAIATWRMAHDGVKQASQMLQANSSAGDAVEALIKTVEAYPYYKSVGYGGLPNENGVVEMDAAFMDGDTLAQGAVAGIHNVFHAVSVARALSHEHYNSFLVGEGATQYAQLNGFEMRNMLTDRAKQRWEKRRQEIADAKVKPYDGHDTVGAITLAPGGSMAAATSTSGLFMKRPGRVGDSPLSGSGFYVDSDVGGAAATGLGEDIMKGCLSYDIVRRMGEGRTPQQACDEAVYPFIEKLKSRYGKAGEFSLIALDRQGNWGVATNVEFTFSVGTASQEPAILIAHPGPNQTTNIEPITQAWLDAYEKRIKAPIE

SEQ ID NO: 8812 - protein, 439 aa, Lactobacillus casei
VKKETLAALYDAQRPEFMDALRSIMQIKSVRGPSRPDAPFGSGPRAALDAAAELGTAYGFQTKVINGAMTAIQWGDDDQHYIGIVGHLDVVPAGEVAWHFPPYDLTEQNGRLYGRGILDNKGPSMACLFGMKLLKEAGYRPTKTIRLILGSDEESGSADVPRYLASQAPPDFGFTPDCKFPVVYGERGIVNYQLTTPITDGSLANIGEIRGDQASDHVPDQLEVMVNGQLIRVTGKRAPSNAPELGDNAITRLADTLLNQPAVHGQFADYCRWLVTKLADQHNGVGLGMAFADAASGNLIVTPYQWQKAGQTLTLRLAIRYPVTYHEADVMQALAAAVLPRTAIEVIRSLPGVLHDRQDPRLQDLSQAYEQITGQPGQLVTTTGATYARAMPNIVAFGPSFPGQKGIAHNADEWMDEQDLKLNMLIDMTAMMKLGGMTD

SEQ ID NO: 8813 - protein, 239 aa, Lactobacillus casei
MAKLEEVADELSRRVRDGIYTTSQRLPSEYDLAKEFAVSRLTVRKAIDLLIRKQLLVKSPGKGTYVMSYSDKVESGRMGLQGFTEAAKAYGKKSRTEVISFGPLEPIPEEIGRVLGCDQQVHKTVDLLVRRRFWDEEPMTVEHIAICHEYIEGLQPQDFEGSLFALLEKRVAIAYSHQEVEAVLMDPDLAALLDGKKGDPILLVHSVTYTADAKPILYDISYYRADKYSFKSTLTRDHV

SEQ ID NO: 8814 - protein, 368 aa, Lactobacillus casei
MGTVFRRTISDKIFITALVCAGLSFLIGTPQFTDINWNTIGTLLSLMIGVQLLRTMHILDALSDWLLVKSQHTRQMTQFFILLAFGGSMILTNDIAILTLVPTFMTLNRHQKGAIAYPLTLIVMAANLGSSFTPIGNPQNLFLVTSYHIDILTFFKLSAPLMIASLILLVALSLWVPRKSLTMVPAKSTTIHVSQIGIATSLIGFIMLVIFNLIPISLVIIVTIIVGLRIDWHVFQHVDYALLLTFVCFFLFVSAISHNSYITLWLNQLMQTPQSVYIASLMTSQAISNVPAAILLANFTKYLPALFLGVNIGGLGSIVASLANLLAVKQLLLFSEEQSLWHFLKVFTVLNLIGLLILGVFGWLYLLM

SEQ ID NO: 8815 - protein, 82 aa, Lactobacillus casei
MNWQKVWAVNKYWVMSKSQQQYDYIRLLAKNNQWTPQKTQELGNIIDSLESVSPTKQTLTTTYQHIWGYFKKNVPMKSYISI

SEQ ID NO: 8816 - protein, 130 aa, Lactobacillus casei
LNSILQQIITEMMTSFGNSAFDLLTGKLDFANLVIETQKSFGKTLCQLLGVMLEQQDQVLADSSYRKQFFKIKDMRERHVDTSIGTVSFRRRYYEDVRTNERIFLLDEQIGLEKSSRLGLDLKAKLLEPV

SEQ ID NO: 8817 - protein, 106 aa, Lactobacillus casei; identical to SEQ ID NO: 2138

SEQ ID NO: 8818 - protein, 156 aa, Lactobacillus casei
VIVDAQSVKTTDLTKNSGYDGGKKISGIKRHMAVDINRLPQAILVTRANVSDRSGALAMFSLASQNLELVQPVMVDGGYTGNDFTDQVMLILNAKTTVAKRNELHTFTVLPQRWIIERSWSWLDKCRRLWKNCERALNSSLQMIVLAFPKIVLKRY

SEQ ID NO: 8819 - protein, 85 aa, Lactobacillus casei
MPKKLIHIVMLAMLMLTQVGSAVVPVADNGETNITEHDRAAPKSDPSSHQNDASGQAAISQDTIESDKKQISAAMSSSENLSSIF

SEQ ID NO: 8820 - protein, 297 aa, Lactobacillus casei
VIKQRRQAYRAIEEVSQGHHGAVTKLLDVIGVSRQAYYKGLRREKTLWEVHDRQLKERTQYWFDFHHQGIGAGNLLINLQQDELIDFPVTIKQVRRVMRELGIRCQIRQKRHSRVKQSEQYLQDNVLNQCFYVERPNQVWLADSTELKYGINGEYKMRLSGVLDLYGRNLLAYNLSATETTAAEIQVFQRAFTRASNVHPLIHTDRGSAYTSKAFNRYLSQFEVTRSMSRPGTPYDNAPMERWWNEFKLRWMDRHPMAKTYKEFVQLVEDGIHYFNHDNRSGQRDGLTPEEYWNKAI

SEQ ID NO: 8821 - protein, 103 aa, Lactobacillus casei
MSRTTTFEERIKVVEYVTKGKHSYTEAAAHFDVSYQQARSWVIKAREGGYEALVDNRGHHKDKRDLTELDKAKLRIRQLEAELKDKELVEAFVKKLLEIQHKE

SEQ ID NO: 8822 - protein, 185 aa, Lactobacillus casei; identical to SEQ ID NO: 2664

SEQ ID NO: 8823 - protein, 288 aa, Lactobacillus casei
LSVFGEQDNSALVAAELLIRQQESRLTVNQPHSEIMTINQLAGYDNTEISCGTYALIKNAVLASQKHFGFNALIGPLVKLWKIGFNGANVPSDHDIKSRLLLSNPDNIIMDDALHTVKLVKTGMELDLGGIAKGFIADQIRSIWFAYGIRAGIINLGGNLLFVGESPRRSDGRWIVGIQDPNKGRNIGIGTVIKPACAAVTSGIYERFLIKGGKRYHHLLDPQTGYPLQTQLAAVTVFARDSLQGELEAKRLFFAGKPIPGWEKDPNNLGAVFIYQNGNTQTVKASIH

SEQ ID NO: 8824 - protein, 227 aa, Lactobacillus casei
NADPHDEPENDENTFMNREDCTASEMLHYVGIAGTNIQRSTNLKLLQYMKKHYSEEAVIEIVDISNLPVFYKASQDHIPEAVNVISGKIRKADGVIIATPEYDHAIPAVLSSALAWFSYRIHPFAGKPVMIVGASYGSLGTSRAQAQLRQILDSPELKASIMPSSEFLVGHSLEAFDDSGNLKNLRLGVQLNGLFSDFSVFVKLTKQMIHSQKQAKEQTKNVNWQDN

SEQ ID NO: 8825 - protein, 437 aa, Lactobacillus casei
NADPHAZREDCTASEMKIVAIAGSIADISYNRQLLTFIASHYASQIDIELLEIKNIPMFNEDKDQTQSAAVQYLVHKIESADGVILATPEHNHTTSPAMKNVIEWLSYKVHPLNQKPVLIVGASWHTQGSSRAQLALRQIMESPGVGALVMPSDEFLLADAKKAFDELGNLKDSKTIAFLDTVINKFIRWINVLDALQEKKKQEPWRQEDLAGKHPVETSIDIDISDDWVEKAAKLVKATSGNHYVQLNRGVLTVDQLNWFLNTMPVELTFMDDNDQFIYYNHFLDHDAMLAPRDPKQVGNTADLVHPKRAVEHVQQVIWALRQGQKELIAMPVPGNKINQKYIMHFYKAMHDADGRYRGVNEWVLDIWPIVSDYLRRTGQKLIKDPDSKPDATTSASQSEPQRVLSSRVEGKDVQTINDMKTSTADAITGASETTK

SEQ ID NO: 8826 - protein, 415 aa, Lactobacillus casei
MRIAIGLDVSSKQTSVSVVAEPQREVDSCTITNDLLGFDKLLKLIHQYSDQDTEQIPEVVFEATGVYSRRLKHFLEIHAVPYMQLNPLQAKHDLSMIKGLHGRKTDRMDALGLSQSQLILNRSKSFVEDPVYMALKDLDRTYQEAVQDLVTNKNRLHRYLQLTFPELEHVTGTTDGIFYWRLVQTFPHPQILLKSRQNFDAFVETLRHLTPYPTSEQRAKSIADKLGKVALTAAPAVSAVPVELEQVQYIAGELIRLSARRKHLIKEMCSLAIPLPELKIFESLPGIGVTSAVTLLAELGDLTRFKKSNQVNAYVGIDLRHYESGDYTASDHISKRGNPYARKILYRVINCMVSSAARSNKPNHIVDYYKKKKQSSSAVGTKKIAIASVSRLIRTLYSLVINNQTYVYRIATKGR

SEQ ID NO: 8827 - protein, 416 aa, Lactobacillus casei
MKSMAQLEYHYGLKVRVYPSDHQKKLIKLNSDASRFVYNEMVAIGKELWQLKQVKLPIDTVQDRIKQLELRQNAKQMSNHFQFLEDKRIDSLAKANAIRNYRKAWKAFRKVHSTGVPKFHRKSYAWGYQTNCQYIQQKTMQLTNGTICFEDDKHVLVPKLGRLRIKGSHKRLLNRKAETRIGTVTITKDTADRFFLSMQLGSDTPFTTKPAKTNRQTGIDLNTENFLTTSDGKVIANPHYYRTIKGRLAKEQRILSLRARRAKKEHRPLRNSKNYQKQRLLVAKIHAQVLDRRKNFLHNVSTTLIKNHDLVVAEELRSKNLLKNHALAMSIADVGWRTFLGMLTYKADLYGRQFVTVSPKNTTQTCHHCGFVMGTEGTDKLTLADREWNCPKCQTHHVRDHNAAQNILIKGIAKLA

SEQ ID NO: 8828 - protein, 410 aa, Lactobacillus casei
MNLNVGIDVSKAKLDYCGLDSAKKVIFQDKTTNTPDGAGQIEKLILEWAKRQDDSLKIVIGMEATSVYNIHPTLYFEQSSALSALDATVVTLNPKMTHRYSQLFDDDKTDTIDAFHIADFLRIGRYQVPVTRDEKHIALQRLTRERYHVVKQITDGKNHFLNNLYFRLNTLEAELPTSVFGNTMMTVLSGEKYTLDEIAQMPLQTLTQDLNQLSHGRFGDPEAIAKALQKAIRSSYRLSKTVADSVDQVMAIYINQIRMLQKQLKALDKSITDLCAVIDGSQSTQSIPGVGPVYSAGLLAEIGQIERFPSEASLASYAGLVWRRSQSGNGERQLTPRTHNGDQYLRYYLIEAANSVRAHDPTFARFYDKKYREVPKYQHRRACVMTARKLVRVIYALLKNHELYKPAKAV
